United States Patent 11,446,398 (REGULATED BIOCIRCUIT SYSTEMS) - sequence listing, part 72

SEQ ID NO: 172220 - DNA, 4230 bp, Homo sapiens
  Payload ID: 13865
  Gene Symbol: PCDH15
  Gene Name: protocadherin-related 15
  Uniprot ID: Q96QU1
  ENST ID: ENST00000373955
  CDS Start-End: 293-3178
aacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctgtaagtagaaggcattgattaatattctgaactgtactgagaaaaatccttaacactcataaatgaccgaatcacaagacagcaaaagtagtctctgtaaatttcaccctatttattcatacattttatgttcttttacttatttcatccacaggtacagagcatatttcagatgactattattgaacctagacaaagaatatgctttttgtttttctagaatgcacaatgtactaattactaatttatctaacaatgataaatatatatgaattgtctccatttgtaagcttcacttaatctggatatgttttaaatttatgtattttccactgtatgcatatatgactattttgttagcaaactccaaatcaacatatcacatgaaacttatattgaatgtgtttattttggtaaattaaaaagcttaagattgcttacagaaaatagttaacattcttttatcatatagaactttacttttttgagatatcccaaattatctttcaaggcaaggttttaattaaaatattattatagtgagagtgataaaataccatgtataattaatagtatacatataaaaaagctttctataaataccttgttttataaatattaattattatcctgatgatttaaatttttctctgagtgggctcacactgtaagttggtggctgataaattttagaaaaatacaaataaaagttaaatgaactattttagaagagtaagaaaataaaatcctgaatcttataagtgatttagaagttctgttttctattgctaatataaatagtatttcttttaatgcttgtatttaattaaaagtgaatggccatcataacatttttcagcttcgatttggacaagtcttataaactctattgtgactatatggaatcaaaatgtattaatgttaatatgaaagtggtgggctttaattcagaagctccttttcttaagtgtgttaaaatgtctttgaaactgctttattgtgctttgggatatatgataggcaaaaatttcatagacttgaacccatcaataaagatagtgaatgtgaaa

SEQ ID NO: 172221 - DNA, 6931 bp, Homo sapiens
  Payload ID: 13865
  Gene Symbol: PCDH15
  Gene Name: protocadherin-related 15
  ENST ID: ENST00000373956
  CDS Start-End: 396-2360
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacagcacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaattcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttcagttgctgtcttattctctttatttctcattgtgctttcccttcccttctttataatgaaaataaatct

SEQ ID NO: 172222 - DNA, 7032 bp, Homo sapiens
  Payload ID: 13865
  Gene Symbol: PCDH15
  Gene Name: protocadherin-related 15
  ENST ID: ENST00000373957
  CDS Start-End: 396-6284
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttcagttgctgtcttattctctttatttctcattgtgctttcccttcccttctttataatgaaaataaatct

SEQ ID NO: 172223 - DNA, 9237 bp, Homo sapiens
  Payload ID: 13865
  Gene Symbol: PCDH15
  Gene Name: protocadherin-related 15
  ENST ID: ENST00000373965
  CDS Start-End: 396-5429
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtgaccaattttttaaaagatattttaattaatttttacttacatttttaataaactgtgctttttattgtcactgagaaaacaatgtatggaatttatatcatgcacacaagctaaaactttgaacaatatgctttaaaattttaagagacagatttgcactcacattgttatcaattaatcgtttttcccagaaaatccttttggacatactttcactaaataacctatcgtttaaacatttagctgttttgttgggtcttgaatttttgttcattttaataaacaagaaataattactaaataatcatttatattttattgattaacatagattatgctttatttctagctccacaaaacatttttagtacatgtaattttattttccatagccaaaagggcaaaaaagaagtaagaggatatttacaggcaatgagtttatacagctgctgtctatactgccctaatttttaaaatgaaagctagaattgcaaagtaaagtaaatgagggaatcacctgtaaataattaattattttaaatcatgagcttgttttctttctttattgtcctgtataaaggttttcacattttaccataaatacatttatatcttgaccctttaggaaaccacttgaagtcgtatgtctttttatcaatattatttacaatattctcttgtcccttcatctcatatcaaatatggtagatactttagtttagtttaatcacttgaggttaaataattgtttggagcaacatggaaatctcacccttagcaaaagcttttagggaagtgagaaaggttcgagtaagcagtaatgcatctagaacgacaatttcataatggaagacatggtgaggttagggaagtctcacattaatgtcactagactttaatagtttgtaaacccagcatatcagagtaaaggaatttggcagggttgaaatgtatataatatataaagcttataaaggctatgaattcataacttcaaatgttgtgtttaacttcttccattttcaggttatttatagaatattttaatgcacatatttatgtgcctaaaatccagaaccaggaaatcattgcctgggcattttttaaaatcaaagaacatggtcttgattttttaccattgaacaaagcacagtgtttcatcataagtagaaatgaaaacagaatatcctttaaaaaacttgccttgtgtgttgcttattttccagatgatgtaaaaagaatgaaacaatatagattaagagaattcagaattctattgaatattacttagtatgatatagatgtagctcacttcaaattttgcacagtattgaccaagttcaggttttaatgaaatttcctcatgcatgcttaatatatggttgaaggactgaataatgcactattatttattcccctcttacatgtttcgcgtcttaaaaattgtttattattatgctatttcctcatttccaaagtgaatgaattgtactgacataaacttgccgacttgtaagagtagtatgtttttacttcagatttccaagaaaatatttgagatcaaatacagtaacatctcatctaccttattttattgagaattaatgcattccatacccttgccaaaaaaacaaaacaaaacaaacaaacaaaaaaaaacctagtggcattagctagattagaaacgtagaatcatgaccacacctcctggcctgccaaacaagcatccacattttcaaaagatcctaaggtggtttatatgcacattaaattttggaagcaatgaagtccggggcttattccttcaggcaccaaagcaatggtttttagtataggatactttgtataggaattagattaagcatatatttccctactaattcaatcagaggtcatcgaatataatttaatattatcttgatacccccagatcatctcagtcagcatcccttgatattctctctatatacagcttcatggctgcgtttttgtcctttgatttctggctgtgacatttaacttattctgttgttgtgcctttctcacatttttttctttcagtttatagcttctagtatcctgatgggaaagtttgtgttttttgtttgttttcttaatgttgaaaaatcatgaagcttaagatgggaattaggtacacggattcaaccaaatgttttgcgactcttagacgctttctttggttaccagtagatttggaaatatgatgttggcagaagtctagtggcctgacatatgagatgtcactgtattttaaactacattttttatgagaaaatatgcaaaattttacaagccacttagcagacacatttcagtaatttaaacttgatcatttcagtaaaaacaatcatgaggtcaatcatctgttacttaatggagatagtataaagagaagcagaatttacacagagcaaccaaaccaaatatttggtcagtatatttttgggtaacgtagagcagcaaaattattactaactaaataaatctggatcaattaaatagttactttcatagaactttcactagtctataaatccctgactcaggattaaaactgtggaacccagaggaaatacccaggtatgtttaatcttaagaatacttcatataaataacgtttcaatgtaaatatttataaagaaattggttgttatttttcctaggaaggtgtaggaaggttttcttgttgttctcaatcagcactagcttcaatcaggcagaagaaacagcaggtcttggctaatcgaggtgagaacagaatgatgtaatgactaatattgcaacccgttgattttagaaggtcttgtgggcattaagggaaagcagaggaagaatgagaaaatatggtcagagtgacataggacatttgtgacttaatgaccatcgaatcacaggtgttaatctccctctctcaatttgtctttctcattaattacagactctgagagttgtcatagaattgcaaccgtaggttggccaaaaccatctttttaaaatacagaagaaagtttgccttgaattttatatgtgatatgtcattcatgttattttaccacattgttcacagggatgttaaagactattatttacttaagtggttgttccaaaggtgattcagtagttaccattaaaatattatttaaaaacatttttatatcatagagccagaagtaattgaatattgactctcgagggaagacattttctgtcttttatttcatgagctttgatttttctctttctctgcttcaccttctgcactttataccttaagtgggatttatataccacttgaatttaattagcaaaataggcaaaaagtgctaataatctattctcagggcagatgcctattggtgcctgcaaattacacagcgataaggctgaaggataggttcaaaataatgttgaggacttacacattttatagatagtttctttctattcccaaatggtatgtgaaatttttgttctattttttttattggttttcaatagttaattttgatctttatcataagaagctttagttatagactggtatttttttcattgcaatctactttaaatttatggtcagttaagcacatgtatggaagattcgaacattgtctatagtttgaaaaatctatcaacaccttcactgctttcccaatttctttatccaaatacctgttcttccttaacaaatattatgttactgtataagaatctgaattagaagttttaagttaaaatgcattgttattcactacacaatgtttcaaaaataaattttcatttgaaaa

SEQ ID NO: 172224 - DNA, 7002 bp, Homo sapiens
  Payload ID: 13865
  Gene Symbol: PCDH15
  Gene Name: protocadherin-related 15
  ENST ID: ENST00000395430
  CDS Start-End: 396-6254
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacaacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaattcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttcagttgctgtcttattctctttatttctcattgtgctttcccttcccttctttataatgaaaataaatct

SEQ ID NO: 172225 - DNA, 6901 bp, Homo sapiens
  Payload ID: 13865
  Gene Symbol: PCDH15
  Gene Name: protocadherin-related 15
  ENST ID: ENST00000395432
  CDS Start-End: 396-6143
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccggaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacaacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaattcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttcagttgctgtcttattctctttatttctcattgtgctttcccttcccttctttataatgaaaataaatcttgagtcgttg

SEQ ID NO: 172226 - DNA, 6942 bp, Homo sapiens
  Payload ID: 13865
  Gene Symbol: PCDH15
  Gene Name: protocadherin-related 15
  ENST ID: ENST00000395433
  CDS Start-End: 396-6194
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacaacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttcagttgctgtcttattctctttatttctcattgtgctttcccttcccttctttataatgaaaataaatct

SEQ ID NO: 172227 - DNA, 5806 bp, Homo sapiens
  Payload ID: 13865
  Gene Symbol: PCDH15
  Gene Name: protocadherin-related 15
  ENST ID: ENST00000395438
  CDS Start-End: 396-5018
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacaggtattcaagggacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgaataggaattatccatggagtctggaattgatcctggccaggaatatggacaagattattacagttatgagcatgggtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttga

SEQ ID NO: 172228 - DNA, 3177 bp, Homo sapiens
  Payload ID: 13865
  Gene Symbol: PCDH15
  Gene Name: protocadherin-related 15
  ENST ID: ENST00000395440
  CDS Start-End: 396-2555
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattttgatatgacttatgatcagaagcatgccagaaaagtgaatatatatgttgtccaaatccatttgtatattagactgtattagagtaaaactgactaatccttcctatattagtaaatcagaacacatgcaatcagctaatcaatatttaatatttactggtaggatttttgttaatgcaatgtggcattatgtattatcagtgacactctgtctattggaatggatggcatatatatatatatatatatatacacacacacactatatatgtttttatatcatctttcaaaataaatactaagacaagcttcaacaaattatatctttaacagtcgtctacttttgcatatatgtacgtttcaactggcaaaggtattataaaaactatcatgaacatgttcaaataagtaagtttgtatctgcaacttcaagtattaggaattcaatgaaataacatttttcaattaattaaaagttattacagcttattttctgttattattagctacagt

SEQ ID NO: 172229 - DNA, 2970 bp, Homo sapiens
  Payload ID: 13865
  Gene Symbol: PCDH15
  Gene Name: protocadherin-related 15
  ENST ID: ENST00000395442
  CDS Start-End: 396-2348
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattttgatatgacttatgatcagaagcatgccagaaaagtgaatatatatgttgtccaaatccatttgtatattagactgtattagagtaaaactgactaatccttcctatattagtaaatcagaacacatgcaatcagctaatcaatatttaatatttactggtaggatttttgttaatgcaatgtggcattatgtattatcagtgacactctgtctattggaatggatggcatatatatatatatatatatatacacacacacactatatatgtttttatatcatctttcaaaataaatactaagacaagcttcaacaaattatatctttaacagtcgtctacttttgcatatatgtacgtttcaactggcaaaggtattataaaaactatcatgaacatgttcaaataagtaagtttgtatctgcaacttcaagtattaggaattcaatgaaataacatttttcaattaattaaaagttattacagcttattttctgttattattagctacagt

SEQ ID NO: 172230 - DNA, 5917 bp, Homo sapiens
  Payload ID: 13865
  Gene Symbol: PCDH15
  Gene Name: protocadherin-related 15
  Uniprot ID: Q96QU1
  ENST ID: ENST00000395445
  CDS Start-End: 396-5747
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattttgatatgacttatgatcagaagcatgccagaaaagtgaatatatatgttgtccaaatccat

SEQ ID NO: 172231 - DNA, 3948 bp, Homo sapiens
  Payload ID: 13865
  Gene Symbol: PCDH15
  Gene Name: protocadherin-related 15
  ENST ID: ENST00000395446
  CDS Start-End: 396-3341
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatggggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattttgatatgacttatgatcagaagcatgccagaaaagtgaatatatatgttgtccaaatccatttgtatattagactgtattagagtaaaactgactaatccttcctatattagtaaatcagaacacatgcaatcagctaatcaatatttaatatttactggtaggatttttgttaatgcaatgtggcattatgtattatcagtgacactctgtctattggaatggatggcatatatatatatatatatatatacacacacacactatatatgtttttatatcatctttcaaaataaatactaagacaagcttcaacaaattatatctttaacagtcgtctacttttgcatatatgtacgtttcaactggcaaaggtattataaaaactatcatgaacatgttcaaataagtaagtttgtatctgcaacttcaagtattaggaattcaatgaaataacatttttcaattaattaaaagttattacagcttattttctgtt

SEQ ID NO: 172232 - DNA, 5401 bp, Homo sapiens
  Payload ID: 13865
  Gene Symbol: PCDH15
  Gene Name: protocadherin-related 15
  ENST ID: ENST00000409834
  CDS Start-End: 577-4029
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagaattatccatggagtctggaattgatcctggccaggaatatggacaagattattacagttatgagcatgggtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattttgatatgacttatgatcagaagcatgccagaaaagtgaatatatatgttgtccaaatccatttgtatattagactgtattagagtaaaactgactaatccttcctatattagtaaatcagaacacatgcaatcagctaatcaatatttaatatttactggtaggatttttgttaatgcaatgtggcattatgtattatcagtgacactctgtctattggaatggatggcatatatatatatatatatatatacacacacacactatatatgtttttatatcatctttcaaaataaatactaagacaagcttcaacaaattatatctttaacagtcgtctacttttgcatatatgtacgtttcaactggcaaaggtattataaaaactatcatgaacatgttcaaataagtaagtttgtatctgcaacttcaagtattaggaattcaatgaaataacatttttcaattaattaaaa

SEQ ID NO: 172233 - DNA, 448 bp, Homo sapiens
  Payload ID: 13865
  Gene Symbol: PCDH15
  Gene Name: protocadherin-related 15
  ENST ID: ENST00000458638
  CDS Start-End: 172-448
tatgcaggatttccaggaaaatggaaacatcattccctagaaacagttgaagttgacagacctagaggttgacaaaaggacacgacactagggaatttgcattgtcatgtttcgaaataccattccaaagacctgcaaataagatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaa

SEQ ID NO: 172234 - DNA, 9234 bp, Homo sapiens
  Payload ID: 13865
  Gene Symbol: PCDH15
  Gene Name: protocadherin-related 15
  ENST ID: ENST00000414778
  CDS Start-End: 396-5426
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacaggtattcaagggacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtgaccaattttttaaaagatattttaattaatttttacttacatttttaataaactgtgctttttattgtcactgagaaaacaatgtatggaatttatatcatgcacacaagctaaaactttgaacaatatgctttaaaattttaagagacagatttgcactcacattgttatcaattaatcgtttttcccagaaaatccttttggacatactttcactaaataacctatcgtttaaacatttagctgttttgttgggtcttgaatttttgttcattttaataaacaagaaataattactaaataatcatttatattttattgattaacatagattatgctttatttctagctccacaaaacatttttagtacatgtaattttattttccatagccaaaagggcaaaaaagaagtaagaggatatttacaggcaatgagtttatacagctgctgtctatactgccctaatttttaaaatgaaagctagaattgcaaagtaaagtaaatgagggaatcacctgtaaataattaattattttaaatcatgagcttgttttctttctttattgtcctgtataaaggttttcacattttaccataaatacatttatatcttgaccctttaggaaaccacttgaagtcgtatgtctttttatcaatattatttacaatattctcttgtcccttcatctcatatcaaatatggtagatactttagtttagtttaatcacttgaggttaaataattgtttggagcaacatggaaatctcacccttagcaaaagcttttagggaagtgagaaaggttcgagtaagcagtaatgcatctagaacgacaatttcataatggaagacatggtgaggttagggaagtctcacattaatgtcactagactttaatagtttgtaaacccagcatatcagagtaaaggaatttggcagggttgaaatgtatataatatataaagcttataaaggctatgaattcataacttcaaatgttgtgtttaacttcttccattttcaggttatttatagaatattttaatgcacatatttatgtgcctaaaatccagaaccaggaaatcattgcctgggcattttttaaaatcaaagaacatggtcttgattttttaccattgaacaaagcacagtgtttcatcataagtagaaatgaaaacagaatatcctttaaaaaacttgccttgtgtgttgcttattttccagatgatgtaaaaagaatgaaacaatatagattaagagaattcagaattctattgaatattacttagtatgatatagatgtagctcacttcaaattttgcacagtattgaccaagttcaggttttaatgaaatttcctcatgcatgcttaatatatggttgaaggactgaataatgcactattatttattcccctcttacatgtttcgcgtcttaaaaattgtttattattatgctatttcctcatttccaaagtgaatgaattgtactgacataaacttgccgacttgtaagagtagtatgtttttacttcagatttccaagaaaatatttgagatcaaatacagtaacatctcatctaccttattttattgagaattaatgcattccatacccttgccaaaaaaacaaaacaaaacaaacaaacaaaaaaaaacctagtggcattagctagattagaaacgtagaatcatgaccacacctcctggcctgccaaacaagcatccacattttcaaaagatcctaaggtggtttatatgcacattaaattttggaagcaatgaagtccggggcttattccttcaggcaccaaagcaatggtttttagtataggatactttgtataggaattagattaagcatatatttccctactaattcaatcagaggtcatcgaatataatttaatattatcttgatacccccagatcatctcagtcagcatcccttgatattctctctatatacagcttcatggctgcgtttttgtcctttgatttctggctgtgacatttaacttattctgttgttgtgcctttctcacatttttttctttcagtttatagcttctagtatcctgatgggaaagtttgtgttttttgtttgttttcttaatgttgaaaaatcatgaagcttaagatgggaattaggtacacggattcaaccaaatgttttgcgactcttagacgctttctttggttaccagtagatttggaaatatgatgttggcagaagtctagtggcctgacatatgagatgtcactgtattttaaactacattttttatgagaaaatatgcaaaattttacaagccacttagcagacacatttcagtaatttaaacttgatcatttcagtaaaaacaatcatgaggtcaatcatctgttacttaatggagatagtataaagagaagcagaatttacacagagcaaccaaaccaaatatttggtcagtatatttttgggtaacgtagagcagcaaaattattactaactaaataaatctggatcaattaaatagttactttcatagaactttcactagtctataaatccctgactcaggattaaaactgtggaacccagaggaaatacccaggtatgtttaatcttaagaatacttcatataaataacgtttcaatgtaaatatttataaagaaattggttgttatttttcctaggaaggtgtaggaaggttttcttgttgttctcaatcagcactagcttcaatcaggcagaagaaacagcaggtcttggctaatcgaggtgagaacagaatgatgtaatgactaatattgcaacccgttgattttagaaggtcttgtgggcattaagggaaagcagaggaagaatgagaaaatatggtcagagtgacataggacatttgtgacttaatgaccatcgaatcacaggtgttaatctccctctctcaatttgtctttctcattaattacagactctgagagttgtcatagaattgcaaccgtaggttggccaaaaccatctttttaaaatacagaagaaagtttgccttgaattttatatgtgatatgtcattcatgttattttaccacattgttcacagggatgttaaagactattatttacttaagtggttgttccaaaggtgattcagtagttaccattaaaatattatttaaaaacatttttatatcatagagccagaagtaattgaatattgactctcgagggaagacattttctgtcttttatttcatgagctttgatttttctctttctctgcttcaccttctgcactttataccttaagtgggatttatataccacttgaatttaattagcaaaataggcaaaaagtgctaataatctattctcagggcagatgcctattggtgcctgcaaattacacagcgataaggctgaaggataggttcaaaataatgttgaggacttacacattttatagatagtttctttctattcccaaatggtatgtgaaatttttgttctattttttttattggttttcaatagttaattttgatctttatcataagaagctttagttatagactggtatttttttcattgcaatctactttaaatttatggtcagttaagcacatgtatggaagattcgaacattgtctatagtttgaaaaatctatcaacaccttcactgctttcccaatttctttatccaaatacctgttcttccttaacaaatattatgttactgtataagaatctgaattagaagttttaagttaaaatgcattgttattcactacacaatgtttcaaaaataaattttcatttgaaaa

SEQ ID NO: 172235 - DNA, 6937 bp, Homo sapiens
  Payload ID: 13865
  Gene Symbol: PCDH15
  Gene Name: protocadherin-related 15
  ENST ID: ENST00000448885
  CDS Start-End: 396-2360
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacagcacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttcagttgctgtcttattctctttatttctcattgtgctttcccttcccttctttataatgaaaataaatct

SEQ ID NO: 172236 - DNA, 3357 bp, Homo sapiens
  Payload ID: 13865
  Gene Symbol: PCDH15
  Gene Name: protocadherin-related 15
  ENST ID: ENST00000414367
  CDS Start-End: 396-1385
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattttgatatgacttatgatcagaagcatgccagaaaagtgaatatatatgttgtccaaatccatttgtatattagactgtattagagtaaaactgactaatccttcctatattagtaaatcagaacacatgcaatcagctaatcaatatttaatatttactggtaggatttttgttaatgcaatgtggcattatgtattatcagtgacactctgtctattggaatggatggcatatatatatatatatatatatacacacacacactatatatgtttttatatcatctttcaaaataaatactaagacaagcttcaacaaattatatctttaacagtcgtctacttttgcatatatgtacgtttcaactggcaaaggtattataaaaactatcatgaacatgttcaaataagtaagtttgtatctgcaacttcaagtattaggaattcaatgaaa

SEQ ID NO: 172237 - DNA, 6804 bp, Homo sapiens
  Payload ID: 13865
  Gene Symbol: PCDH15
  Gene Name: protocadherin-related 15
  ENST ID: ENST00000437009
  CDS Start-End: 396-6056
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaagcacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataatcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttcagttgctgtcttattctctttatttctcattgtgctttcccttcccttctttataatgaaaataaatct

SEQ ID NO: 172238 - DNA, 6425 bp, Homo sapiens
  Payload ID: 13865
  Gene Symbol: PCDH15
  Gene Name: protocadherin-related 15
  ENST ID: ENST00000617271
  CDS Start-End: 396-5015
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagaattatccatggagtctggaattgatcctggccaggaatatggacaagattattacagttatgagcatgggtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattttgatatgacttatgatcagaagcatgccagaaaagtgaatatatatgttgtccaaatccatttgtatattagactgtattagagtaaaactgactaatccttcctatattagtaaatcagaacacatgcaatcagctaatcaatatttaatatttactggtaggatttttgttaatgcaatgtggcattatgtattatcagtgacactctgtctattggaatggatggcatatatatatatatatatatatacacacacacactatatatgtttttatatcatctttcaaaataaatactaagacaagcttcaacaaattatatctttaacagtcgtctacttttgcatatatgtacgtttcaactggcaaaggtattataaaaactatcatgaacatgttcaaataagtaagtttgtatctgcaacttcaagtattaggaattcaatgaaataacatttttcaattaattaaaagttattacagcttattttctgttattattagctacagt

SEQ ID NO: 172239 - DNA, 9249 bp, Homo sapiens
  Payload ID: 13865
  Gene Symbol: PCDH15
  Gene Name: protocadherin-related 15
  ENST ID: ENST00000614895
  CDS Start-End: 396-5441
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacaggtattcaagggacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtgaccaattttttaaaagatattttaattaatttttacttacatttttaataaactgtgctttttattgtcactgagaaaacaatgtatggaatttatatcatgcacacaagctaaaactttgaacaatatgctttaaaattttaagagacagatttgcactcacattgttatcaattaatcgtttttcccagaaaatccttttggacatactttcactaaataacctatcgtttaaacatttagctgttttgttgggtcttgaatttttgttcattttaataaacaagaaataattactaaataatcatttatattttattgattaacatagattatgctttatttctagctccacaaaacatttttagtacatgtaattttattttccatagccaaaagggcaaaaaagaagtaagaggatatttacaggcaatgagtttatacagctgctgtctatactgccctaatttttaaaatgaaagctagaattgcaaagtaaagtaaatgagggaatcacctgtaaataattaattattttaaatcatgagcttgttttctttctttattgtcctgtataaaggttttcacattttaccataaatacatttatatcttgaccctttaggaaaccacttgaagtcgtatgtctttttatcaatattatttacaatattctcttgtcccttcatctcatatcaaatatggtagatactttagtttagtttaatcacttgaggttaaataattgtttggagcaacatggaaatctcacccttagcaaaagcttttagggaagtgagaaaggttcgagtaagcagtaatgcatctagaacgacaatttcataatggaagacatggtgaggttagggaagtctcacattaatgtcactagactttaatagtttgtaaacccagcatatcagagtaaaggaatttggcagggttgaaatgtatataatatataaagcttataaaggctatgaattcataacttcaaatgttgtgtttaacttcttccattttcaggttatttatagaatattttaatgcacatatttatgtgcctaaaatccagaaccaggaaatcattgcctgggcattttttaaaatcaaagaacatggtcttgattttttaccattgaacaaagcacagtgtttcatcataagtagaaatgaaaacagaatatcctttaaaaaacttgccttgtgtgttgcttattttccagatgatgtaaaaagaatgaaacaatatagattaagagaattcagaattctattgaatattacttagtatgatatagatgtagctcacttcaaattttgcacagtattgaccaagttcaggttttaatgaaatttcctcatgcatgcttaatatatggttgaaggactgaataatgcactattatttattcccctcttacatgtttcgcgtcttaaaaattgtttattattatgctatttcctcatttccaaagtgaatgaattgtactgacataaacttgccgacttgtaagagtagtatgtttttacttcagatttccaagaaaatatttgagatcaaatacagtaacatctcatctaccttattttattgagaattaatgcattccatacccttgccaaaaaaacaaaacaaaacaaacaaacaaaaaaaaacctagtggcattagctagattagaaacgtagaatcatgaccacacctcctggcctgccaaacaagcatccacattttcaaaagatcctaaggtggtttatatgcacattaaattttggaagcaatgaagtccggggcttattccttcaggcaccaaagcaatggtttttagtataggatactttgtataggaattagattaagcatatatttccctactaattcaatcagaggtcatcgaatataatttaatattatcttgatacccccagatcatctcagtcagcatcccttgatattctctctatatacagcttcatggctgcgtttttgtcctttgatttctggctgtgacatttaacttattctgttgttgtgcctttctcacatttttttctttcagtttatagcttctagtatcctgatgggaaagtttgtgttttttgtttgttttcttaatgttgaaaaatcatgaagcttaagatgggaattaggtacacggattcaaccaaatgttttgcgactcttagacgctttctttggttaccagtagatttggaaatatgatgttggcagaagtctagtggcctgacatatgagatgtcactgtattttaaactacattttttatgagaaaatatgcaaaattttacaagccacttagcagacacatttcagtaatttaaacttgatcatttcagtaaaaacaatcatgaggtcaatcatctgttacttaatggagatagtataaagagaagcagaatttacacagagcaaccaaaccaaatatttggtcagtatatttttgggtaacgtagagcagcaaaattattactaactaaataaatctggatcaattaaatagttactttcatagaactttcactagtctataaatccctgactcaggattaaaactgtggaacccagaggaaatacccaggtatgtttaatcttaagaatacttcatataaataacgtttcaatgtaaatatttataaagaaattggttgttatttttcctaggaaggtgtaggaaggttttcttgttgttctcaatcagcactagcttcaatcaggcagaagaaacagcaggtcttggctaatcgaggtgagaacagaatgatgtaatgactaatattgcaacccgttgattttagaaggtcttgtgggcattaagggaaagcagaggaagaatgagaaaatatggtcagagtgacataggacatttgtgacttaatgaccatcgaatcacaggtgttaatctccctctctcaatttgtctttctcattaattacagactctgagagttgtcatagaattgcaaccgtaggttggccaaaaccatctttttaaaatacagaagaaagtttgccttgaattttatatgtgatatgtcattcatgttattttaccacattgttcacagggatgttaaagactattatttacttaagtggttgttccaaaggtgattcagtagttaccattaaaatattatttaaaaacatttttatatcatagagccagaagtaattgaatattgactctcgagggaagacattttctgtcttttatttcatgagctttgatttttctctttctctgcttcaccttctgcactttataccttaagtgggatttatataccacttgaatttaattagcaaaataggcaaaaagtgctaataatctattctcagggcagatgcctattggtgcctgcaaattacacagcgataaggctgaaggataggttcaaaataatgttgaggacttacacattttatagatagtttctttctattcccaaatggtatgtgaaatttttgttctattttttttattggttttcaatagttaattttgatctttatcataagaagctttagttatagactggtatttttttcattgcaatctactttaaatttatggtcagttaagcacatgtatggaagattcgaacattgtctatagtttgaaaaatctatcaacaccttcactgctttcccaatttctttatccaaatacctgttcttccttaacaaatattatgttactgtataagaatctgaattagaagttttaagttaaaatgcattgttattcactacacaatgtttcaaaaataaattttcatttgaaaa

SEQ ID NO: 172240 - DNA, 1143 bp, Homo sapiens
  Payload ID: 13865
  Gene Symbol: PCDH15
  Gene Name: protocadherin-related 15
  ENST ID: ENST00000615043
  CDS Start-End: 1-113
gtatgaaatgcctcaatatgggagtcgccgtcgattgttaccaccagctggacaggaggaatatggtgaggtggttggtgaagctgaggaagaatatgaggaggaagaggtaattactgaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattttgatatgacttatgatcagaagcatgccagaaaagtgaatatatatgttgtccaaatccat

SEQ ID NO: 172241 - DNA, 1896 bp, Homo sapiens
  Payload ID: 13865
  Gene Symbol: PCDH15
  Gene Name: protocadherin-related 15
  ENST ID: ENST00000495484
  CDS Start-End: 392-1642
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaagtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagagaggttatggatcagagcaacagcaactgctgaggccctctcttcttaaaccagaggaattatccatggagtctggaattgatcctggccaggaatatggacaagattattacagttatgagcatgggtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtgaccaattttttaaaagatattttaattaatttttacttacatttttaataaactgtgctttttattgtcactgagaaaacaatgtatggaatttatatcatgcacacaagctaaaactttgaacaatatgctttaaaattttaagagacagatttgcactcacattgttatcaattaatcgtttttcccagaaaatccttttggacatactttcactaaataacctatcgtttaaacatttagctgttttgttgg

SEQ ID NO: 172242 - DNA, 580 bp, Homo sapiens
  Payload ID: 13865
  Gene Symbol: PCDH15
  Gene Name: protocadherin-related 15
  ENST ID: ENST00000613346
  CDS Start-End: 363-580
gctatcaggaggagcaaaagggaaggatctgctgctgggggctcgctgggtgaccctttgccagacgaaaagagctggtcgagagagaagcgcttggcaggagctctctgcgggacctaagctccgtggctgctcgggatccctacgtccgctgctgctgaaggagcagaggggaggacgccagcggttgcttactggagcctggaggaaaatggaaacatcattccctagaaacagttgaagttgacagacctagaggttgacaaaaggacacgacactagggaatttgcattgtcatgtttcgaaataccattccaaagacctgcaaataagatcagctttgagtgaactttgacagaagatgtttcgacagttttatctctggacatgtttagcttcagggatcatcctgggctctctctttgaaatctgcttgggccagtatgatgatggtacaattctggtggacaacatgctgatcaaagggactgctggaggaccagaccccaccatagaactttctttaaaggataatgtggattactgggtgttgatggatcctgttaagcaaatgctttt

SEQ ID NO: 172243 - DNA, 6820 bp, Homo sapiens
  Payload ID: 13865
  Gene Symbol: PCDH15
  Gene Name: protocadherin-related 15
  ENST ID: ENST00000622048
  CDS Start-End: 396-6062
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaagcacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacaggtattcaagggacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaattctttcaagtcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttcagttgctgtcttattctctttatttctcattgtgctttcccttcccttctttataatgaaaataaatcttgagtcgttg

SEQ ID NO: 172244 - DNA, 1461 bp, Homo sapiens
  Payload ID: 13865
  Gene Symbol: PCDH15
  Gene Name: protocadherin-related 15
  ENST ID: ENST00000618301
  CDS Start-End: 1-1383
ctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgagaggttatggatcagagcaacagcaactgctgaggccctctcttcttaaaccagaggaattatccatggagtctggaattgatcctggccaggaatatggacaagattattacagttatgagcatgggtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtgaccaattttttaaaagatattttaattaatttttacttacatttttaataaactgtgctttttattgtcactgagaaaa

SEQ ID NO: 172245 - DNA, 6329 bp, Homo sapiens
  Payload ID: 13865
  Gene Symbol: PCDH15
  Gene Name: protocadherin-related 15
  ENST ID: ENST00000613657
  CDS Start-End: 396-5768
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttgaaagagatcacagtaggtggaagttttgctgtgatgagtgctctcgtgtgcagtgccttctgtgtgttctccaaagtgacacttgaaagggaggaaattgatcaagattttgatatgacttatgatcagaagcatgccagaaaagtgaatatatatgttgtccaaatccatttgtatattagactgtattagagtaaaactgactaatccttcctatattagtaaatcagaacacatgcaatcagctaatcaatatttaatatttactggtaggatttttgttaatgcaatgtggcattatgtattatcagtgacactctgtctattggaatggatggcatatatatatatatatatatatacacacacacactatatatgtttttatatcatctttcaaaataaatactaagacaagcttcaacaaattatatctttaacagtcgtctacttttgcatatatgtacgtttcaactggcaaaggtattataaaaactatcatgaacatgttcaaataagtaagtttgtatctgcaacttcaagtattaggaattcaatgaaa

SEQ ID NO: 172246 - DNA, 5765 bp, Homo sapiens
  Payload ID: 13865
  Gene Symbol: PCDH15
  Gene Name: protocadherin-related 15
  ENST ID: ENST00000612394
  CDS Start-End: 396-5765
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatgttccacccagtggagttcctacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacaggtattcaagggacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgtatgaaatgcctcaatatgggagtcgccgtcgattgttaccaccagctggacaggaggaatatggtgaggtggttggtgaagctgaggaagaatatgaggaggaagaggaagagccaaagaaaattaaaaaaccaaaggttgaaattagagagcctagtgaggaggaagaagtagttgtaactatcgaaaaaccaccagcagctgagcctacatacacaacatggaagagagccagaatattccccatgatttttaagaaagttagaggattagctgataaaagaggaatcgttgaccttgagggtgaagagtggcagagacgccttgaggaagaagataaagattatttgaaactcactctggaccaagaggaagcaacagaaagcactgtagaatcagaggaggaatcctccagcgactatactgaatacagtgaagaagagtctgagttcagtgagtctgagactacagaagaggaatctgagtcagagacaccctctgaggaggaggagagttccacccctgaatcagaagaatcggaatccacagagtcagaaggagaaaaagcaaggaaaaacattgtgcttgcaagaagaaggcccatggttgaggaggtcaaggaagtcaagggtaggaaagaggagccacaagaagaacaaaaagaacctaagatggaagaagaagaacactcagaagaagaagaaagtggaccagcccctgtggaagaaagtacagaccctgaagctcaagatatccctgaagagggcagtgcagaatcagcttcggtggaaggaggtgtggaaagtgaggaggaatcagaatcaggtagtagtagcagtagtagcgaaagtcagtctggaggtccatggggctatcaggtaccagcgtatgacagaagcaagaatgcaaaccaaaagaagtcgccaggagcaaactctgaaggttacaacacagcactttga

SEQ ID NO: 172247 - DNA, 5846 bp, Homo sapiens
  Payload ID: 13865
  Gene Symbol: PCDH15
  Gene Name: protocadherin-related 15
  Uniprot ID: Q96QU1
  ENST ID: ENST00000616114
  CDS Start-End: 396-5423
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtgaccaattttttaaaagatattttaattaatttttacttacatttttaataaactgtgctttttattgtcactgagaaaacaatgtatggaatttatatcatgcacacaagctaaaactttgaacaatatgctttaaaattttaagagacagatttgcactcacattgttatcaattaatcgtttttcccagaaaatccttttggacatactttcactaaataacctatcgtttaaacatttagctgttttgttgggtcttgaatttttgttcattttaataaacaagaaataattactaaataatcatttatattttattgattaacatagattatgctttatttctagctccacaaaacatttttagtacatgtaattttattttccatagccaaaagggcaaaaaagaagtaagaggatatt

SEQ ID NO: 172248 - DNA, 5700 bp, Homo sapiens
  Payload ID: 13865
  Gene Symbol: PCDH15
  Gene Name: protocadherin-related 15
  ENST ID: ENST00000621708
  CDS Start-End: 396-5444
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacagtttaaagtacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaatgcataagtatgaaatgcctcaatatgggagtcgccgtcgattgttaccaccagctggacaggaggaatatggtgaggtggttggtgaagctgaggaagaatatgaggaggaagagtgggcaagaaaaagaatgatcaagttagttgttgatcgagagtatgaaaccagctcaactggagaagacagtgctcctgaatgtcagagaaaccgtcttcaccatcctagtatccacagtaatatcaacggcaatatatatattgcacagaatggttctgtggtgagaacccgccgtgcctgcctcacggacaacttaaaagttgcttcccctgttcgactgggagggccctttaagaaactagacaagttggcagtgacacatgaggagaatgtacctctgaacacattatcaaaggggccattttctactgaaaaaatgaatgcaagaccaactctggttacatttgccccttgccctgtggggactgacaatacagcggtgaagccactaaggaacaggctgaaaagcacagttgaacaggagtccatgattgacagtaagaacatcaaggaggctttggaatttcatagtgaccacacacagtctgatgatgaagagctttggatgggcccctggaacaacctccatataccaatgacaaaactgtgaccaattttttaaaagatattttaattaatttttacttacatttttaataaactgtgctttttattgtcactgagaaaacaatgtatggaatttatatcatgcacacaagctaaaactttgaacaatatgctttaaaattttaagagacagatttgcactcacattgttatcaattaatcgtttttcccagaaaatccttttggacatactttcactaaataacctatcgtttaaacatttagctgttttgttgggt

SEQ ID NO: 172249 - DNA, 7048 bp, Homo sapiens
  Payload ID: 13865
  Gene Symbol: PCDH15
  Gene Name: protocadherin-related 15
  ENST ID: ENST00000617051
  CDS Start-End: 396-6290
caacgtgctgagctaatagcgacagatagagggcagacagattcctgctagcagcttagtgttagttgcttgtggtaactaaggcaggtggcatacatctcagaacgtggagaatgatggtatgctttctgagttaacatgttgaactgttttgcttttctaaaaattttcctagtaacattttcttgatgatatgagagtggatatcaatgcctcacagaaacaagaggtggaacatgtgaatgaatcgtcttggaactagattatgagcactggttctttttaaagggatgtgcaagaggcagccttggcaagaaaacttgctgcataatcttacatggactaaagatgaaactttaaaccgcaaatcagctttgagtgaactttgacagaagatgtttcgacagttttatctctggacatgtttagcttcagggatcatcctgggctctctctttgaaatctgcttgggccagtatgatgatgactggcaatatgaggattgcaaactagctaggggaggaccaccagctaccatagttgctattgatgaagaaagtcggaatggtacaattctggtggacaacatgctgatcaaagggactgctggaggaccagaccccaccatagaactttctttaaaggataatgtggattactgggtgttgatggatcctgttaagcaaatgcttttcctgaacagcaccggaagagttctggatagagatccaccgatgaacatacactccattgtggtgcaggtccagtgcatcaacaaaaaagtgggcactattatctaccatgaagtgcgaatagtggtgagagacaggaatgacaactcacccactttcaagcatgaaagctactatgccacagtgaatgagctcactccagttggtaccacaatattcacaggattttcaggagacaatggagctacagatatagatgatggaccaaatggacagatagagtatgttattcagtataatccagatgatccgacatccaatgacacctttgaaattcccctaatgttgactggaaatatagtgttaaggaagaggctcaactatgaagataagactcgctactttgtcataatccaagctaatgaccgtgcccaaaatctgaatgagaggcgaaccaccaccaccactctcacagtggatgttctggatggagatgacttgggtccaatgtttcttccttgtgtccttgtgccaaacactcgtgattgccgtccactcacttatcaagctgccatacctgagttgagaactccggaagaactgaaccccattattgttacgccaccaatccaagccattgatcaggaccggaatattcaaccgccatcagataggccaggaatcctctattccatccttgttgggactcctgaggattacccacgatttttccatatgcatcctaggacagcagaacttagtctcctggagccagtaaacagagactttcaccagaaatttgatttggttattaaggctgaacaagacaatggtcatcctcttcctgcctttgccggtctacacattgaaatactggatgaaaacaatcaaagtccatattttacaatgcccagttatcaaggctatatcctggaatctgccccagtgggagcaaccatttcggacagtctcaatttgacttcacctttaagaatagtagctctggacaaggacatagaagatacaaaagacccagagcttcacctttttctgaatgactacacctcagtcttcaccgtcacacagactggtattactcgctacctcaccttacttcaaccagtggacagggaagaacagcaaacttacaccttttcgataacagcatttgatggtgtacaagaaagtgagccagtcatcgtcaatattcaagtgatggatgcaaatgataacacgccaaccttccctgaaatatcctatgatgtgtatgtttatacagacatgagacctggggacagtgtcatacagctcactgcagtcgacgcagacgaagggtcaaatggggagatcacatatgaaatccttgttggggctcagggagacttcatcatcaataaaacaacagggcttatcaccatcgctccaggggtggaaatgatagtcgggcggacttacgcactcacggtccaagcagcggataatgctcctcctgcagagcgaaggaactccatctgcactgtgtatattgaagtgcttccaccaaataatcaaagccctcctcgcttcccacagctgatgtatagccttgaaattagtgaagccatgagggttggtgctgttttattaaatctacaggcaactgatcgagagggagactcaataacatatgccattgagaatggagatcctcagagagtttttaatctttcagaaaccacggggattctaaccttagggaaagcactggacagggaaagcactgatcgctacattctgatcatcacagcttcagatggcaggccagatgggacctcaactgccacagtaaacatagtggtgacagatgtcaatgacaatgctccagtgtttgatccttatctgccaagaaatttatctgtggtggaagaagaagccaatgcctttgtgggtcaagtaaaagcaacagaccctgatgctggaataaatggtcaagtgcactacagtttgggtaactttaataatctttttcgtatcacatccaatgggagcatttacacagcagtgaagcttaacagagaagtcagggactactatgaacttgttgttgtggcaacagatggagcagtacaccctcgtcattcaactctaaccttggccatcaaggttttggacattgatgataacagtcctgtgttcaccaattcaacatacactgtccttgttgaagagaatttgccagctgggactaccatccttcaaatagaggccaaagatgtcgaccttggagcaaatgtgtcttaccggataagaagcccagaagtgaagcacttttttgcactacatccatttacaggagaactatcgcttttaaggagtttagattatgaggcatttccagaccaagaagcaagtatcacttttctggtagaggcctttgatatttatggaacaatgccacctggtattgctactgtcacagtgattgtaaaggatatgaatgattatcctcctgtctttagtaaacgaatatacaaagggatggtggctccggatgcagtcaagggtacacctatcacaacagtttatgctgaagatgcagaccctcctggattacctgcaagtcgtgtgaggtatagagtagatgatgtacagtttccttaccctgccagtatttttgaagtggaagaagattctggaagagtaataacacgagtcaatcttaatgaagaacctacaacaatttttaagttggtggtggttgcttttgatgatggggagcctgtgatgtccagcagtgccacagtgaagattcttgtcttacatcctggtgagatcccacgcttcacacaggaggaatatagacctcctccagtaagtgaacttgccaccaaagggaccatggttggtgtaatttctgctgctgccattaatcaaagtattgtgtactccattgtttcaggaaatgaagaagatacatttggaattaataacatcacaggtgttatctatgtgaatggacctctggattatgagaccaggacaagctatgtacttcgagtccaagctgattccctggaagtggtccttgccaatctccgagttccttcaaaaagcaatacagctaaagtatacattgagattcaggatgaaaataatcatcccccagtgtttcagaaaaaattctacatcggaggtgtatctgaagatgcaagaatgtttacttctgtactcagagtgaaggctactgataaagatactggcaattatagtgtcatggcctacagactcataataccaccaattaaagagggaaaagaaggatttgtagtggaaacatatacagggcttatcaaaactgctatgctcttccataatatgaggagatcctacttcaagtttcaagttattgcaactgacgactatgggaagggactgagcggcaaagccgatgtactcgtctccgtggtcaatcagctggatatgcaagtcattgtttccaatgtgcctcctactctagtggaaaaaaagatagaagatcttacagagatcttggatcgctatgttcaggaacaaattcctggtgccaaggtcgtagtggagtccattggagctcgccggcatggagatgccttttccctagaagattacaccaaatgtgacttgactgtctatgcaattgacccccaaaccaacagagccatcgatagaaatgagctttttaaatttttggatggcaaactacttgatatcaataaagactttcagccgtattatggggaaggaggacgcattctggagatccggactccagaggcagtgaccagcattaaaaagagaggagaaagtctaggatacacagaaggggccttgttggctctggccttcatcatcatcctctgctgcattcctgccatcttggtggttttggtcagctacagacaggtattcaagggacgtcaagctgagtgtacaaagactgcacgaattcaggccgcattacccgcggctaaaccagcagtgccggctcctgcaccagtggcagcgcccccgccgccgccgccgcctccgccaggtgcgcatctctatgaagaacttggagacagctcaattctttcaagtcttttccttctctaccattttcaacaaagcaggggaaataactcagtctcagaagacaggaaacatcaacaagttgtgatgcccttttcttccaatactattgaggctcacaagtcagctcatgtagacggatcacttaagagcaacaaactgaagtctgcaagaaaattcacatttctatctgatgaggatgacttaagtgcccataatcccctttataaggaaaacataagtcaagtatcaacaaattcagacatttcacagagaacagattttgtagacccattttcacccaaaatacaagccaagagtaagtctctgaggggcccaagagaaaagattcagaggctgtggagtcagtcagtcagcttacccaggaggctgatgaggaaagttccaaatagaccagagatcatagatctgcagcagtggcaaggcaccaggcagaaagctgaaaatgaaaacactggaatctgtacaaacaaaagaggtagcagcaatccattgcttacaactgaagaggcaaatttgacagagaaagaggaaataaggcaaggtgaaacactgatgatagaaggaacagaacagttgaaatctctctcttcagactcttcattttgctttcccaggcctcacttctcattctccactttgccaactgtttcaagaactgtggaactcaaatcagaacctaatgtcatcagttctcctgctgagtgttccttggaactttctccttcaaggccttgtgttttacattcttcactctctaggagagagacacctatttgtatgttacctattgaaaccgaaagaaatatttttgaaaattttgcccatccaccaaacatctctccttctgcctgtccccttccccctcctcctcctatttctcctccttctcctcctcctgctcctgctcctcttgctcctcctcctgacatttctcctttttctcttttttgtcctcctccctctcctccttctatccctcttcctcttcctcctcctacattttttccactttccgtttcaacgtctggtcccccaacaccacctcttctacctccatttccaactcctcttcctccaccacctccttctattccttgccctccacctccttcagcttcatttctgtccacagagtgtgtctgtataacaggtgttaaatgcacgaccaacttgatgcctgccgagaaaattaagtcctctatgacacagctatcaacaacgacagtgtgtaaaacagaccctcagagagaaccaaaaggcatcctcagacacgttaaaaacttagcagaacttgaaaaatcagtagctaacatgtacagtcaaatagaaaaaaactatctacgcacaaatgtttcagaacttcaaactatgtgcccttcagaagtaacaaatatggaaatcacatctgaacaaaacaaggggagtttgaacaatattgtcgagggaactgaaaaacaatctcacagtcaatctacttcactgtaatgttgcttttcttattttagtcgggcaaacctcttgttgatcatagtcttcaagttgaacatcaaatttgaacgtcaaagaagactctattattttaccccaaattcaatgaaatgcagttttttttctcgtttttaatttaaaaagatattaacctcatcactactaactcactcatataatagatttaccttactttttaaaaactacaaagtagcataatttgttctacatttatttgaaaagtaagtaattttaatctcttttttagtgggaatatgtgggcatgaaaattagatacccaacttaaaccaaaggcatgtctatcatgtggatgcagtaacatttacatttagtttttgatcgtagttttatatgaatgttccaagaaaaaagcagactgttacaaataagttaaaactgatatgattgataggttctgttttttcttgaagcctatgtatttggtaagaagaaatactaccgaagtaaaatataatgtacctagattgtaggagatgacagacataaggtatttcaaaataaatctcaggtgctataacatgtagtcatctgttttctgataagaacatcttttactctgacttgcttttatcttagtagtatgcttatggatttagtagtatgcttatggatttgataaatcttatactttttcagttgctgtcttattctctttatttctcattgtgctttcccttcccttctttataatgaaaataaatcttgagtcgttg

SEQ ID NO: 172250 - DNA, 11967 bp, Homo sapiens
  Payload ID: 13866
  Gene Symbol: PRTG
  Gene Name: protogenin
  Uniprot ID: Q2VWP7
  ENST ID: ENST00000389286
  CDS Start-End: 49-3501
gacaggggctctgggcggccggggagcatgcccgcgcggctacgctgaatggcgcctcctctgcgacccctcgcccggctgcgaccgccggggatgctgctccgcgcgctcctgctcctgctgctgctcagtcctttgccaggagtgtggtgctttagcgaactgtcttttgtaaaagaaccacaggatgtaactgtcacaagaaaggacccagtcgttttagattgccaggctcacggagaagttcctattaaggtcacatggttgaaaaatggagcaaaaatgtctgaaaataaacggatcgaggttctttctaacggctctttatacatcagtgaggtggaaggcaggcgaggagagcagtccgatgaaggattttatcagtgcttggcaatgaacaaatatggagccattcttagtcaaaaagctcatcttgccttatcaactatttctgcatttgaagtccagccaatttccactgaggtccacgaaggtggagttgctcgatttgcatgcaagatttcatcccaccctcctgcagtcataacatgggagttcaatcggacaactctacctatgactatggacaggataactgccctaccaacaggagtattgcagatctatgatgtcagccaaagggattctggaaattatcgttgtattgctgccactgtagcccaccgacgtaaaagtatggaggcctcgctaactgtgattccagctaaggagtcaaaatccttccacacaccaacaattatagcaggtccacagaacataacaacatctcttcatcagactgtagttttggaatgcatggccacaggaaatcccaaaccaatcatttcttggagccgccttgatcacaaatccattgatgtctttaatactcgggtacttggaaatggtaatctcatgatatctgatgtcaggctacaacatgctggagtatatgtttgtcgggccactacccctggcacacgcaactttacagttgctatggcaactttaactgtattagctcctccttcatttgttgaatggccagaaagtttaacaaggcctcgagctggcactgctcgatttgtgtgtcaggcagaaggaatcccctctcccaagatgtcatggttgaaaaatggaaggaagatacattcgaatggtagaattaaaatgtacaacagtaaattggtaattaaccagattattcctgaagatgatgctatttatcagtgcatggctgagaatagccaaggatctattttatctagagccagactgactgtagtgatgtcagaagacagacccagtgctccctataatgtacatgctgaaaccatgtcaagctcagccattcttttagcctgggagaggccactttataattcagacaaagtcattgcctattctgtacactacatgaaagcagaaggtttaaataatgaagagtatcaagtagtcatcggaaatgacacaactcattatattattgatgacttagagcctgccagcaattatactttctacattgtagcatatatgccaatgggagccagccagatgtctgaccatgtgacacagaatactctagaggatgttcccctgagacctcctgaaattagtttgacaagtcgaagtcccactgatattctcatctcctggctgccaatcccagccaaatatcggcggggccaagtggtgctgtatcgcttgtctttccgcctaagtactgagaattcaatccaagttctggagctcccggggaccacgcatgagtaccttttggaaggcctgaaacctgacagtgtctacctggttcggattactgctgccaccagagtggggctgggagagtcatcagtatggacttcacataggacgcccaaagctacaagcgtgaaagcccctaagtctccagagttgcatttggagcctctgaactgtaccaccatttctgtgaggtggcagcaagatgtagaggacacagctgctattcagggctacaagctgtactacaaggaagaagggcagcaggagaatgggcccattttcttggataccaaggacctactctatactctcagtggcttagaccccagaagaaaatatcatgtgagactcctggcttacaacaacatagacgatggctatcaggcagatcagactgtcagcactccaggatgcgtgtctgttcgtgatcgcatggtccctcctccaccaccaccccaccatctctatgcgaaggctaacacctcatcttccatcttcctgcactggaggaggcctgcattcaccgctgcacaaatcattaactacaccatccgctgtaatcctgttggcctgcagaatgcttctttggttctgtaccttcaaacatcagaaactcacatgttggttcaaggtctagaaccaaacaccaaatacgaatttgccgttcgattacatgtggatcagctttccagtccttggagccctgtagtctaccattctactcttccagaagcaccagcaggcccaccagttggagtaaaagtgacattaatagaggatgacactgccctggtttcttggaaaccccctgatggcccagaaacagttgtgacccgctatactatcttatatgcatctaggaaggcctggattgcaggagagtggcaggtcttacaccgtgaaggggcaataaccatggctttgctagaaaacttggtagcaggaaatgtgtacattgtcaagatatctgcatccaatgaggtgggagaaggacccttttcaaattctgtggagctggcagtacttccaaaggaaacctctgaatcaaatcagaggcccaagcgtttagattctgctgatgccaaagtttattcaggatattaccatctggaccaaaaatcaatgactggcattgctgtaggtgttggcatagccttgacctgcatcctcatctgtgttctcatcttgatataccgaagtaaagccaggaaatcatctgcttccaagacggcacagaatggaactcaacagttacctcgtaccagtgcctccttagctagtggaaatgaggtaggaaagaacctggaaggagctgtaggaaatgaagaatctttaatgccaatgatcatgccaaacagcttcattgatgcaaagggaggaactgacctgataattaatagctatggtcctataattaaaaacaactctaagaaaaagtggttttttttccaagactcaaagaagatacaagttgagcagcctcaaagaagatttactccagcggtctgcttttaccagccaggcaccactgtattaatcagtgatgaagactcccctagctccccaggtcagacaaccagcttctcaagaccctttggtgttgcagctgatacagaacattcagcaaatagtgaaggcagccatgagactggggattctgggcggttttctcatgagtccaacgatgagatacatctgtcctcagttataagtaccacaccccccaacctctgattctttcactggcagtgattcaggtggagattccgcattgaggaagtgtgaagaccctgctgtgtcatctgttagtgagcagacttcctccttagttctgcagccgccatctgccatgctatgctttgataaaaatgattttccaatctagacggccatgctcaggtattctcaccattaaatctgttcgaaggacaatgaacagggaaccaaagccttttgtgaaaatcttaatatctttatggggtattttagctttttttgaatgtgttttgttttttatttttaaacttgtgtaatttgaatgtttcattgtcagcaatgtgaaagaacggtcgagatgtttgactggattataaaatatatcactggagcaaagggaagacttttgaaagcccctttgctgactatctacctcagtttgcctcccggcaaactctgaagacaactttgttacctcatttgttgttatagtttatctcagctacataaccaatgatacttcctagtagtattgtgttttcattgctgtacgtgtaatgtgtgtgatcaaaggagtcatataggtagatgagtaagaatgtttatctgaagctctgatttttttaaaaaaagaaactatgacatctgcatggtttggataagttcatacctctggctgtgaggaccgttaaaccactgagaagaggaaaagtggggctatttcttctaacgatgaccaaaacaagaaagtatatttcttttgagaacagaactattcaataccaggtagggatcattttgcttaaaaggcctttatgttttgggcattagagtctgagtgctttatctcctatatcccaaacctcaagctgcccagaactgtgccttttctaccttcccctttgcctgacggttggccaaaggctgcactgtctagtttgcaaagcatcctcaactttgccagtattagttgcaaaaccccatgcagaatatggatttttaaagaaaatgggttaaggtggttttttttctttttttaaatcccagtttggcttaaaggagtgaagacatttcatgaactattaagaatgaaggtaaatgcaacagtagacagtaaaatgaactcgaagttattatggtaacagtgcctttcagtataatgaaattctttgccttatacctttttaatattcatgaaattgtttaggaacaggagtacaaaaagttgccttaagagtttcttggattttatcagtaactattttgatgtatagtatcttaccaaggcattttttttaagtgcaggttttgtttagggataaatattcagagttctaccaccctacttgtgttttcttgaattctttagagaatatggtatctacttaatcttccttcagtgtcagtgctgtgaatgaggaatgctaactccaggagtgagttaatcctcttgcaggtttgaaatcagcaaattgtttactcagctacataacataggccttttctccgtcatgagacagttacctaggtgccgagcagtgggagaggataaagaactaaacgcgtgtagagaaggggtcccatatccttttaaaagtattttttcaaattttctggaagtgacttttgattctcattttaaaaggaatcataatgggtttacacttgaaatgctttgttcctagaggaggcagggtcatgttcactgatgttctaaaatcaaaggaatattagcagataatagtcccagcatcatctgctagtctaatgactgtagatataacatttttaatttttttaaatctgtaattttgtgccaaactggatgtgattaagactaaagttcaatgccagcaaccacttctgaactaaactcagagtcccccagttagttatctaagtacggaattcatcgcaaaacaaacaaaaaagcagagctttaggtgaacagtctgcagcaaggaaaaatgctgctcctgcctttatagctcctgttttatactacctccttttaaagttattctagtgttattttttttcctgtactcagggaacgttttgttacttttgagctgcctcatggaagcataggcagattgacagggtatagcgctttgtggttggtaagtagaagtatatagggccaacttttatcagtatctaaaattaagtacagtgagatcattttatttttaagctttcattaaaaggcaaacaaaatctaaagctgaaacatcatccatcatggttatggaagatgtgtctaggactacatgaattcgagtggttttaaatggctaaaaagacgagctaaagtccttgaggaaagtattttgtttgtttggtttttgatgaataggcttatagttacaatagaactttaggctataactatttgataattatttaacagtacattttttaccttttcattttgttcttatacggactttttcataataattctgttaccaaagaattttcagtagaaaataaaattttgattataattccccccaaattgaattaactagaagcatttatagatatgaaacttacacaagtagttactaacccaaaacaatagggtttatattgattgttgtagttaaatagattagtaatgttaactaccttattgttaccagagcatttaaaataagttgtaatactttctttaccagcagatcgttccaaagaatttcaggtatagttttttcttcagcaagtaaatcttcaactatacagtattaaagtatttttatattgttgaaactacttgttggagagaaaattttttttttttaccaaaaataaatactttggtctcattgaataagatatttagtaatacagcaaagacttctttttacttgaccaaatcaagcttctttgaagtcttaagtatgaaattgtaattaaaatgtgaagattttcactcatttttcatagtggtattacttcatggtattgtacttcaaaggggctaatatgcaaatggtaactattttcttttccaaagatgtatttgctgtaagtactgatacctgcatgtcatttttatgccaaatattacaagatactgctcatcagtattttcataccaaagaccattaagatgtataggttagcctgtaagtaagtaaagatgagcagatttgaaataaatttatttagaggccgatagagaatctagctttagtagcaaaaaatatcaaagggctaagtttacataattaaaagcaatacaattatattggtatttatcagtgtttttattcaagtactttttatcagcaaattaaaaagaaaaaaaccaaagatatttaaggttacctccgcatataggcaaatatagttgtacattaaactgttgtttcttgtttttatgttaaaccaaacatgtctcttcggaacacagtctgtatacaaataacatgcatgaggactttccatttaatctgtgattcagccacatgatgtttttgccaaatgatgtgatactttccaaagcaccttgagtgtgaaatgtcaacagaaatatcagcaagcttttatgttgcagagtattatggtacctctgaattagcctgtatagttctcttcctgctttaagcattacctggttagctcagacggcttgaggcagtcccttaataatagggatgcttttcatctctaaggatgtaagaggcaaacaaatcatgtcattctttaagtgggctatgctttgatagatgtgctctttaaaggtgtgagattggaatttagagttgttaaattgaaatgtttgcattgcaccaaaggagctcagttttcaaactttaatggaaccttgggtaaagggaaaaaatttttaatgaaatctggggttttatattttgattagcctaaaagtaaaaatacagctttatccattaagtgacttttaaaaatcagttttgccataccaaagaaattagattcttagtgtcacatgctatacttttgtctgtgcttgaaacgagcaatgccaacattgggaacaatgacagaggtttgcatcagtttgtcttggctttgttaaggacttctgccagaaatgtgctcgtggttgacaacccaggatcattgttcaagttcttatgcagacacctttgaaaacaattcagatcgtgtcacaagaatttggaattgaaaatatcatttattttttaatgcaagaatacccagatgtggtttcacttcagcagtagctatagtggttcacttatatacatttctgtttcactgaatgtaaattttgaatactgaatgtaaaaaaaaaactccagttatattgaaacagtcactaagactgcacatgtgttttgcagactttcttcctgaccatttgccacatgggtctctgataagattctgttggtttaatagtcaaaataatctttgcagtttgtgagcactgagtagcaggttctggagactaccatatacaaccagttgtctaattgtgatttttttattgatgtttagaagaatgtaaccgtagagttctgtgttaagttgatttatgctcaggacataagatcacaggctaatgcaatgtgtatgtttcaggctttaatcttctcaatttccctttttaagccgttgatggtgtttaagattaacatgacagtcttgtatttttaccagatactgtattatttttcctattgctgctgtaacacattaccatgaaggtggtggcttaaaataacacaaatttttcttaagttctgcagatcagaagtctaacacaggtctccctgggacaaaatcaaggcgcttgcagggctgtttctttttgaggctttagggaaaaatctatttccttttctagttttttaaggctgggaacccctccttccatcttcaaagccagccatgtagcatctctctgaagctccttccgttatcatttctctttgtccaaccccagctgatacaggttatctaggtttaaggattccagtgatcacattgagcccacctaaataatccaggataatctccccaactgaagttcctcaacttaatcacatctacagagttccttttgctatgtttggtaacatattcactggttccagggatttgggcatggacttctgtaggtggccagtattttgcccacaacaggtacattctttctgtggaattctgatccctgtaaaatgtctgtagcattaaagagattggaaatctgaggtcatgtgccccttggggatctttaaagattaaaagcatgaaaactttgacttgtagcctaccaaaattatacactaaactttctctccaaaatacttgtgaaacaatttatctttaaagtttctgaatatgtgcttcataaaataacatctcatgtttatcagcaagtgtcctaaatatttgcgtctaactttatggaatttattcagaaaaagaattgaaaactcttcttatagttaccctttctccttttctcttcagtggttatgttgctggggaagagttgggggaagacctcaaaacacaggaactcagagtgatgaacaggaccatgctcaagtttattctttgttttcttttaatgacatattcacaacattcacaactttctgcctttaaatctggttcctctcttcagcttcaccaagccactgaatgcttttcagttttattaaccctcacattccccatccttctcagcaagagcctctccttatgccatcagcatgtatatacatttcctaggaaatttgatctttcttgtcattcttttttggttccaatcggccttttcctggttctcaaagctctagtttcttctaatttctggatcatcgcaagtctggccctctttgaactttaaaacataatgtctaattccaccccaattttcagcatttcttcaactaaatcgataaagctgtctccattatgagaaaggccagaataatactccgagtaagcataagaaagctggtcattttacaacttctcccgactctaggaagtaatatgatgccatttgttgagcatctacagtgtgccaagcacatggttcatctctgcaaactgctgctacattctgtaaagcaagtattatccgcattttagggattaggaacagcttcctgatctcttgccaaaagtcacagctagtgagtggtttaggcaagatacaaaccctagttagttaatccttactcagaagtgtataggactatgatacattgtctcagcttaaaaaaaaaaaaaaaaaaaaaaggtatttaatcacccagggtcatagtgccttccatagtgtgaccagatacaactgttttttccttgtatccacaaaagccaggttgtgtcagaacaacctttctacagagtaataaccaatcgaaaaagagaagactaccttatttaaatccacttattcacaggagggattaaggcggctgtaactcatcccttatcatctcctaatttctctcctccaaaaccttccatttatctcagctaaaattgtgtctgaaggctgtttgtacttagagttacattacaaataaggtaggcatggtttctagagtccttttctagtcaagcatttccttattcgacaatgtcttcagaattgcattttatcttttgtaattttctgtagctcccatattccaaacaggaattcattgacttgaaaaagtcaggtgtgtaaacagtaatcctttcttgttaggtctgaagagttcatgattttttatgaatataaactaatttattatttgcattaatgtaggagacagcaaagttaacggagagtcataaaacagaacaagtataagttaggctttggagcacctaagttctaatcttgacaattttgagaatcgtttggtacaaaaattcttaaactgtttctgtgccttctccatccatgaaatgaggataatttttttgtgcaaaatgaaacaatagtactttgaaaacttaagagaaaattcaagtgtaaataatcataatctgaaactcatttgtatgaggctgtgaaagattttacagactctttcttttcaagtcagcctttgcaattatattttgcctttgttgaaatgaaaaatgtttgcatctcccgtacgcatacacaaaaccaatagaagaaagtggttggtaaaagatatagctgaaatggaaacactcatatgttaggtggataaaatcataagagaaaatgggaattgactgtactttcaaagtactaaatttgaagtcatcttactccaatttaagtcatatatatatatatatatatatatatatatatatatatatatatatatatattggcttttaaagagttaaagagagaatcagatctgtccagcaggatagatgggtgaggagaaaagtacatatttaggatttttctctaaaagatctttttcaagattatggagtattttaatatttctgcaaactattccaaatgaatgcattttatatagggcaacacatactggcacctgattctggtttattcgagttcatatgtagggtttgttgggaagaattatatgattggcttctttttttagaggaaatattttcccttttttcttatccatatactattctgaacagctttgcagatttccttaagttcatagcttgtaagtagttcatggtatatagacatagtcttgacttacaactgaaaaaaaatttatgttacagaagtttattttttctatggaactgtctttaaaaacaaaaatattacaaatcttgaccttgaaatattctgtttcctgttatcacattctggatatctattttgtttgcaaatgaaaattattactgatgattagcaacttgagcctgttaataggaaattgcaaagcctgaatacacacacattgccttagcctatcagtagagtagaggacatatgttaagaaaatgtgtctgcttgttgctgttgttggacaaaattttatgtctgtgtgtatgatttttttttttctattttcttcaaagatgtgaattaaatgaaagtgtgggagccagttaaattattttgtattatgggtgttctggatcctttcactccgtataccattttcttgtaagggcagcatttgtagacttgctaatggactgtagagctgagctatattaattttatacttgactcaggggatcagttctgtgaatgccattgcacgaagaaagcaaatgtttgccttgattttgaatgtatctttttaatgtcttcttaaaacatatttgtttaataatgtagatttgtttttttttttctagtatcatagtaaatattgcttagtacttgcccccaccccactgggtagtttatatactaccctataggtcatgccaaaaatgaataaaagtttaaatgccaaaatgtttatgaaactgctgtctaaatactgattgattgcacaatttaaataaaagctttccttagttaaaaaa

SEQ ID NO: 172251 - DNA, 576 bp, Homo sapiens
  Payload ID: 13866
  Gene Symbol: PRTG
  Gene Name: protogenin
  ENST ID: ENST00000558349
  CDS Start-End: 510-576
cttctcgcgccattgtcccggctccggccgcgtccgcgcctccgcgaccggccggactccgggtcgccagcccgccggggccgccgcggctgcacgtggctttatttatattgtttccttagtggcagcctcgccgtgcagggggcgccgcggttcctcgcggcttcccgtgtctgttgtgggagttcccccactttttagggctgcgagagggaataggtgaactcataaccccaatcggcaccagcttgccggatctggatccagccaggaggagatgggagggtggaattggcagggttggaagtgaagtggccgatttgtgccccggaaaggaggggggaaaagtccccgaagctgaaaaggaaggagtgtggtgctttagcgaactgtcttttgtaaaagaaccacaggatgtaactgtcacaagaaaggacccagtcgttttagattgccaggctcacggagaagttcctattaaggtcacatggttgaaaaatggagcaaaaatgtctgaaaataaacggatcgaggttctttctaacggctctttatacatcagtgaggtggaaggca

SEQ ID NO: 172252 - DNA, 1925 bp, Homo sapiens
  Payload ID: 13866
  Gene Symbol: PRTG
  Gene Name: protogenin
  ENST ID: ENST00000561465
  CDS Start-End: 1-657
gagtatcaagtagtcatcggaaatgacacaactcattatattattgatgacttagagcctgccagcaattatactttctacattgtagcatatatgccaatgggagccagccagatgtctgaccatgtgacacagaatactctagaggatgttcccctgagacctcctgaaattagtttgacaagtcgaagtcccactgatattctcatctcctggctgccaatcccagccaaatatcggcggggccaagtggtgctgtatcgcttgtctttccgcctaagtactgagaattcaatccaagttctggagctcccggggaccacgcatgagtaccttttggaaggcctgaaacctgacagtgtctacctggttcggattactgctgccaccagagtggggctgggagagtcatcagtatggacttcacataggacgcccaaagctacaagcgtgaaagcccctaagtctccagagttgcatttggagcctctgaactgtaccaccatttctgtgaggtggcagcaagatgtagaggacacagctgctattcagggctacaagctgtactacaaggaagaagggcagcaggagaatgggcccattttcttggataccaaggacctactctatactctcagtggcttagcccgaatctaataatgaaaccatcagataagtccggattgtgagacattccacaaaacagctcaactggaaatgccatccttggagaagacaggaaaagagcaggagacagttctagatggagacacgatgtggagcgtgtaatcctggattcttgtggggaaaagcagttataaagaacattattggacaattttggaaatttaaatacagactatatattagataaatgctgccattgttaaatttgttgggtataataatactgtgtttatgttggagaacatccctttttagggggaaaatgtcacagtatttaggtgtgatgtgaagtgtcatgattcaataaaaggaaagatgtgtataagtacacacacaaataaaagaataagaaataaagcaaatacattaaaatgtctataactaattttaaaggtttaaaaatgccctatactcttgtactgacaatttttagtctgtagtatctccaaattagataatggttttacaatgattaggcactgaaaggttaaaacaacagcacttctgaagtaattgcttataaaaaaattctctaggaatgtggggatatttaaaagttgtatcagtcagtatatactataagtttgcctcttaagaaattaaggcacagaacatcagtttcttatactgtccagagcccgcctgttcatactgtccaaagtttatactgtctaaagttcatactgtccaaagttctgtcttattcttactgtccaaagcccacttgaggaactaaaggctgtttctgtaactgagtgcataatataaaaatattctgaactgaaattatttccttaaacaactgaataactcattcatgaaatgtttgtaaactgatatttataataatatatttcagattgaatataagaaacctagatctgttgaatgttttatttatcagaaaatctttttggtttaattctatatgcttaatttgtttgaggttctgtgtcatacgtgttgaaaaccattttaagatatgttgaatacctttcagtacccctaagcatcttcagtgtcttttaataactaaaaaatttctggttgaatagactgtttatagccagttaacacattaataatatgcagctgcttggatctaagaactcccagaattcttttatttgctaacattaaaatctattgcagtgagtttacataagttgttgtaacatactgtttcttgtgagttttaaagaaggcataaataaataatcatggttttatcactgtga

SEQ ID NO: 172253 - DNA, 833 bp, Homo sapiens
  Payload ID: 13866
  Gene Symbol: PRTG
  Gene Name: protogenin
  ENST ID: ENST00000561292
  CDS Start-End: 160-573
cctcgccgccgcagagacgctcgccacgccggtgccggagccggagcggggagccaggctgcgtgcgaccagccgcagagcagagagcgcccggggcgggggccgcagacggacaggggctctgggcggccggggagcatgcccgcgcggctacgctgaatggcgcctcctctgcgacccctcgcccggctgcgaccgccggggatgctgctccgcgcgctcctgctcctgctgctgctcagtcctttgccaggagtgtggtgctttagcgaactgtcttttgtaaaagaaccacaggatgtaactgtcacaagaaaggacccagtcgttttagattgccaggctcacggagaagttcctattaaggtcacatggttgaaaaatggagcaaaaatgtctgaaaataaacggatcgaggttctttctaacggctctttatacatcagtgaggtggaaggcaggcgaggagagcagtccgatgaaggattttatcagtgcttggcaatgaacaaatatggagccattcttagtcaaaaagctcatcttgccttatcaaggatagggagtacatagtggaggtggccagataggccatgagaagatgaagcatttgtcatgaccacacattgtttccaggacctcctgagaagcctgatagaatcctagggcttccagaaacacttttggaaaaacacagagctttctaacttcataaataaaatgtgaatggtgtgtgataggtgtaacaaacaaaatgtcagaactggctttttaaatatctttagatttttgcatctctatagaaattatcactaataataaataattacatg

SEQ ID NO: 172254 - DNA, 1686 bp, Homo sapiens
  Payload ID: 13867
  Gene Symbol: PPOX
  Gene Name: protoporphyrinogen oxidase
  Uniprot ID: P50336
  ENST ID: ENST00000352210
  CDS Start-End: 211-1644
gccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtatctctaagggacagcagtctggaggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttg

SEQ ID NO: 172255 - DNA, 1740 bp, Homo sapiens
  Payload ID: 13867
  Gene Symbol: PPOX
  Gene Name: protoporphyrinogen oxidase
  Uniprot ID: P50336
  ENST ID: ENST00000367999
  CDS Start-End: 267-1700
gagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtttctgagcttggcttggattcagaagtgctgcctgtccggggagaccacccagctgcccagaacaggttcctctacgtgggcggtgccctgcatgccctacccactggcctcagggggctactccgcccttcaccccccttctccaaacctctgttttgggctgggctgagggagctgaccaagccccggggcaaagagcctgatgagactgtgcacagttttgcccagcgccgccttggacctgaggtggcgtctctagccatggacagtctctgccgtggagtgtttgcaggcaacagccgtgagctcagcatcaggtcctgctttcccagtctcttccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtatctctaagggacagcagtctggaggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagct

SEQ ID NO: 172256 - DNA, 728 bp, Homo sapiens
  Payload ID: 13867
  Gene Symbol: PPOX
  Gene Name: protoporphyrinogen oxidase
  ENST ID: ENST00000537829
  CDS Start-End: 1-485
aggctgaccacgttattagtgccattccagcttcagtgctcagtgagctgctccctgctgaggctgcccctctggctcgtgccctgagtgccatcactgcagtgtctgtagctgtggtgaatctgcagtaccaaggagcccatctgcctgtccagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactaggtaagttgggaaaacagctgggctgaggagggccaaggacatcagacccccagctaaaacattcctttcatcctttccttccagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttg

SEQ ID NO: 172257 - DNA, 734 bp, Homo sapiens
  Payload ID: 13867
  Gene Symbol: PPOX
  Gene Name: protoporphyrinogen oxidase
  ENST ID: ENST00000537523
  CDS Start-End: 1-692
tccaagctgagcaaacccatcgttccatattactgggcctgctgctgggggcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttg

SEQ ID NO: 172258 - DNA, 816 bp, Homo sapiens
  Payload ID: 13867
  Gene Symbol: PPOX
  Gene Name: protoporphyrinogen oxidase
  ENST ID: ENST00000539753
  CDS Start-End: 230-571
ggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtatctctaagggacagcagtctggaggctgaccacgttattagtgccattccagcttcagggatttggacatttggtgccatcttcagaagatccaggagtcctgggaatcgtgtatgactcagttgctttccctgagcaggacgggagcccccctggcctcagagtgactgtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactag

SEQ ID NO: 172259 - DNA, 664 bp, Homo sapiens
  Payload ID: 13867
  Gene Symbol: PPOX
  Gene Name: protoporphyrinogen oxidase
  ENST ID: ENST00000535223
  CDS Start-End: 184-654
aggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaccaagaaccagttgaagtggcgacagagtcatgacaggaccgtggagtggcctaaggagtacccagggcgaagtaggaaacaggctccttctattcttcatgtgcctgggtgccaactcctcaggtgcagggaccgtgaccacctgggggctgtaagcgaacagccccggagctcggcggagagtagggtgggggtggcgtcctctaccttttctacctttcccctcttctagcgggggtggg

SEQ ID NO: 172260 - DNA, 813 bp, Homo sapiens
  Payload ID: 13867
  Gene Symbol: PPOX
  Gene Name: protoporphyrinogen oxidase
  ENST ID: ENST00000544598
  CDS Start-End: 212-769
cggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtttccgcatgggccggaccgtggtcgtgctgggcggaggcatcagcggcttggccgccagttaccacctgagccgggccccctgcccccctaaggtggtcctagtggagagcagtgagcgtctgggaggctggattcgctccgttcgaggccctaatggtgctatctttgagcttggacctcggggaattaggccagcgggagccctaggggcccggaccttgctcctggtgatgctgggaggttcctggttacagacactggaggctagtggctgtgtcttatctcaggagctgtttcaacagcgggcccaggaagcagctgctacacaattaggactgaaggagatgccgagccactgcttggtccatctacacaagaactgcattccccagtatacactaggtcactggcaaaaactagagtcagctaggcaattcctgactgctcacaggttgcccctgactctggctggagcctcctatgagggagttgctgttaatgactgtatagagagtgggcgccaggcagcagtcagtgtcctgggcacagaacctaacagctgatccccaactctcattcatgaaaataaaaattgctggagcttggc

SEQ ID NO: 172261 - DNA, 3602 bp, Homo sapiens
  Payload ID: 13868
  Gene Symbol: PRPF40B
  Gene Name: PRP40 homolog, pre-mRNA processing factor B
  Uniprot ID: Q6NWY9
  ENST ID: ENST00000261897
  CDS Start-End: 552-3128
ggctcggggcggtcccacagcgccccctgcggcccgggccgtggccgatggggcggggaggccgctggggatagctgggaccccggggagggcgagggaggccaagggtgagggaagagagcccgggaggggggatgggggcggggactgggggcgaaggggcgggggaggccatgatggagcctggccgggggcgaaaggtgcgagagtggcgggactgggtgaagagtgggattgggagaggtgggggtgggttcgcggagaaagatcgggaaagaagagagagggcggagatgaggggactgaggggaccaggggacaggtggggaccagtttcccctcctgggatatttggtgtgcgacatgcccttcccccagccccagcgcccgttccctttggaagcctgggtgctcctcagaccacttggggactccctgcttcaccttcctgcatttgcaagagcttgtctcctgaggtggagagggggcctctgaagaaaggggctcccagcccaggccatcaacaaactaacgactctgtgtgaccttggatgccccctccagggatccccccaccctttcctccgatggggctaccccccatgagtcagagaccaccagctatcccccccatgccacctggcatcctgcccccaatgcttccaccaatgggggcgccaccaccactcacacagataccaggaatggtacctccgatgatgccaggaatgctgatgccagcggtgcctgtcaccgcagcgacggctccgggtgcggacaccgccagctctgctgtggctgggacaggccctccgagggccctatggagtgagcatgtggccccagatgggcgcatctactactacaatgctgacgacaagcagtccgtgtgggagaagcccagcgtgctcaagtccaaggcagagctgctcctgtcccaatgtccctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcagttctggacagcatcagccacagcaggaggaggaggaatcaaagccagaaccagagaggtctggcctcagttggagcaaccgggagaaggcaaagcaggcattcaaggaactgctgagggacaaggctgtcccctccaatgcctcatgggaacaggccatgaagatggtggtcaccgacccccgttacagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggcgggcagaacagacctttggggagctggaggtctgggctgtggtccctgagagggatcgaaaagaggtttatgatgatgtcctcttcttcctggccaagaaggagaaggaacaggccaagcagctccggcgccgcaatatccaggccctaaagagcatcctggatgggatgagtagtgtcaacttccaaaccacgtggtcccaggcccagcagtacctcatggataaccccagctttgctcaggaccatcagctgcagaacatggacaaggaagatgcactgatctgttttgaggagcacatccgagctttggagagggaagaggaggaggaacgggagcgggcccggcttcgggagcgacgccaacaacgcaagaatcgggaggccttccagaccttcctggacgagctgcatgagacagggcagctgcactctatgtccacctggatggagctatatccagcagtcagcactgatgtccgctttgccaacatgctgggccagccgggctccacccctctggacttattcaagttctatgtggaggagttgaaggcacgattccatgatgaaaagaagatcattaaggacatccttaaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagcagactgaatgccagcacctccacaccaaaggccgaaagcatggcaggaaaggcaagaagcaccatcacaagcgttcccactcaccctcaggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatgg

SEQ ID NO: 172262 - DNA, 3154 bp, Homo sapiens
  Payload ID: 13868
  Gene Symbol: PRPF40B
  Gene Name: PRP40 homolog, pre-mRNA processing factor B
  Uniprot ID: Q6NWY9
  ENST ID: ENST00000380281
  CDS Start-End: 65-2680
gtcggttcccgattctggtccccggcccccagcagcgcctgcccccttcccaccggggccccccatgatgccaccacccttcatgccccctccagggatccccccaccctttcctccgatggggctaccccccatgagtcagagaccaccagctatcccccccatgccacctggcatcctgcccccaatgcttccaccaatgggggcgccaccaccactcacacagataccaggaatggtacctccgatgatgccaggaatgctgatgccagcggtgcctgtcaccgcagcgacggctccgggtgcggacaccgccagctctgctgtggctgggacaggccctccgagggccctatggagtgagcatgtggccccagatgggcgcatctactactacaatgctgacgacaagcagtccgtgtgggagaagcccagcgtgctcaagtccaaggcagagctgctcctgtcccaatgtccctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcagttctggacagcatcagccacagcaggaggaggaggaatcaaagccagaaccagagaggtctggcctcagttggagcaaccgggagaaggcaaagcaggcattcaaggaactgctgagggacaaggctgtcccctccaatgcctcatgggaacaggccatgaagatggtggtcaccgacccccgttacagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggcgggcagaacagacctttggggagctggaggtctgggctgtggtccctgagagggatcgaaaagaggtttatgatgatgtcctcttcttcctggccaagaaggagaaggaacaggccaagcagctccggcgccgcaatatccaggccctaaagagcatcctggatgggatgagtagtgtcaacttccaaaccacgtggtcccaggcccagcagtacctcatggataaccccagctttgctcaggaccatcagctgcagaacatggacaaggaagatgcactgatctgttttgaggagcacatccgagctttggagagggaagaggaggaggaacgggagcgggcccggcttcgggagcgacgccaacaacgcaagaatcgggaggccttccagaccttcctggacgagctgcatgagacagggcagctgcactctatgtccacctggatggagctatatccagcagtcagcactgatgtccgctttgccaacatgctgggccagccgggctccacccctctggacttattcaagttctatgtggaggagttgaaggcacgattccatgatgaaaagaagatcattaaggacatccttaaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagcagactgaatgccagcacctccacaccaaaggccgaaagcatggcaggaaaggcaagaagcaccatcacaagcgttcccactcaccctcaggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatgg

SEQ ID NO: 172263 - DNA, 3307 bp, Homo sapiens
  Payload ID: 13868
  Gene Symbol: PRPF40B
  Gene Name: PRP40 homolog, pre-mRNA processing factor B
  ENST ID: ENST00000548825
  CDS Start-End: 156-2834
ttggggccccgctcgccggcgggagccaccggagccccggccacgaaggggtgcgaccccccgccggccccgccctcccggctgcggcctggccaatcagagcggctcttactggcgggtgggctgagccggcccagctgctcggaggctctggcatgtcggttcccgattctggtccccggcccccagcagcgcctgcccccttcccaccggggccccccatgatgccaccacccttcatgccccctccagggatccccccaccctttcctccgatggggctaccccccatgagtcagagaccaccagctatcccccccatgccacctggcatcctgcccccaatgcttccaccaatgggggcgccaccaccactcacacagataccaggaatggtacctccgatgatgccaggaatgctgatgccagcggtgcctgtcaccgcagcgacggctccgggtgcggacaccgccagctctgctgtggctgggacaggccctccgagggccctatggagtgagcatgtggccccagatgggcgcatctactactacaatgctgacgacaagcagtccgtgtgggagaagcccagcgtgctcaagtccaaggcagagctgctcctgtcccaatgtccctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcagttctggacagcatcagccacagcaggaggaggaggaatcaaagccagaaccagagaggtctggcctcagttggagcaaccgggagaaggcaaagcaggcattcaaggaactgctgagggacaaggctgtcccctccaatgcctcatgggaacaggccatgaagatggtggtcaccgacccccgttacagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggcgggcagaacagacctttggggagctggaggtctgggctgtggtccctgagagggatcgaaaagaggtttatgatgatgtcctcttcttcctggccaagaaggagaaggaacaggccaagcagctccggcgccgcaatatccaggccctaaagagcatcctggatgggatgagtagtgtcaacttccaaaccacgtggtcccaggcccagcagtacctcatggataaccccagctttgctcaggaccatcagctgcagaacatggacaaggaagatgcactgatctgttttgaggagcacatccgagctttggagagggaagaggaggaggaacgggagcgggcccggcttcgggagcgacgccaacaacgcaagaatcgggaggccttccagaccttcctggacgagctgcatgagacagggcagctgcactctatgtccacctggatggagctatatccagcagtcagcactgatgtccgctttgccaacatgctgggccagccgggctccacccctctggacttattcaagttctatgtggaggagttgaaggcacgattccatgatgaaaagaagatcattaaggacatccttaaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagactgaatgccagcacctccacaccaaaggccgaaagcatggcaggaaaggcaagaagcaccatcacaagcgttcccactcaccctcaggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatg

SEQ ID NO: 172264 - DNA, 697 bp, Homo sapiens
  Payload ID: 13868
  Gene Symbol: PRPF40B
  Gene Name: PRP40 homolog, pre-mRNA processing factor B
  ENST ID: ENST00000549547
  CDS Start-End: 1-414
cttaaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagactgaatgccagcacctccacaccaaaggccgaaagcatggcaggaaagggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgat

SEQ ID NO: 172265 - DNA, 531 bp, Homo sapiens
  Payload ID: 13868
  Gene Symbol: PRPF40B
  Gene Name: PRP40 homolog, pre-mRNA processing factor B
  ENST ID: ENST00000551063
  CDS Start-End: 514-531
gctaattgaggcgacccggggaggggcgggaccgcggactggatttcgacttccaaattcccacgaggtataggagtctgagggttgcacaggaccttatgcattgtttgactcctccagagcctttagagaaacttctatcaggcccgcctgctaggcactagtcggggagataatgtagccagggagatgtggcggacagaaagggcagagaggctctctgaggagcggatggaggatcgtgggccgctttactgagaaggaagagaccctgcgagaaggagtagtgtcgacttggtcccgtcagccggaccccacctggacggctggggccacttgtggtcgccgggaggtgtcacctctaactcttcgtgtcaggagtttttctacctctccggagttctttggctctcaggaacctagcacggcatcacgcgagtcccggctcagtcggttcccgattctggtccccggcccccagcagcgcctgcccccttcccaccggggccccccatgatgccaccacccttc

SEQ ID NO: 172266 - DNA, 1622 bp, Homo sapiens
  Payload ID: 13869
  Gene Symbol: PRPF40A
  Gene Name: PRP40 pre-mRNA processing factor 40 homolog A
  ENST ID: ENST00000354363
  CDS Start-End: 1-328
actcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgctaaactaaacggatattcactctgaagtgggataaatgaagatgtggagtttcatgttcatgtagggcaggttttgccactatagtgagttttggtaccatacttgaaaaaagttggctttcagagggttttggtttccagaattgtgggtaaaggattgaggaccttgtgtacacttggtgaccatataacatttaaactactcccgtagtctcggttgctgatctcttttacaatttatagcaagctcggggaactgagaccactaaaagttttgctaagaatatgagtcagaggcttgaggattatacatagcagccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatgcaatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacagaaaaagaagaaaaagaa

SEQ ID NO: 172267 - DNA, 8048 bp, Homo sapiens
  Payload ID: 13869
  Gene Symbol: PRPF40A
  Gene Name: PRP40 pre-mRNA processing factor 40 homolog A
  Uniprot ID: O75400
  ENST ID: ENST00000410080
  CDS Start-End: 543-3335
gatcgaaccctctcctccgaacccctcctttcgccttccccgcctcctcccctccgcctcgagcaccgcgcgcgcgcattcggtcccagccaccgctaacactacaggctgcttacccccgccccctccaccctacccctggcggcctcaggtttgtggggcgtacgtaactcgggcggggagggtgaaggtggcagacccccactgccccaccccctacggggtgaggcggtctaagctcgggaagctgggacactgttgtcttcccttcccctggggaagttggtagagttttcccgacggaggactcggcgcagaaacttcctccgtcctcctcctcccccccccccatgcaggcgacgccgagtgaggctgaggctgggggcgaatcgccgcagagctgcgtgtcggcggcgcattctgattggacagcggggaagcccgtcagcctgttggccccgctgatcccgccccgtagcgcagggcagcctttaacctttagccccagtgggcgccagccactcagatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatgcaatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacagaaaaagaagaaaaagaagaagcaagatcaaagtacaaagaggctaaggaatcctttcagcgttttcttgaaaatcatgagaaaatgacttctacaaccagatacaaaaaagcagagcaaatgtttggagagatggaagtttggaatgcaatatcagaacgtgatcgtcttgaaatctatgaagatgttttgttctttctttcaaaaaaagaaaaggaacaagcaaagcagttgcgaaagagaaattgggaagccttaaaaaacatacttgacaacatggctaatgtaacatactctaccacttggtctgaagcccagcagtatctgatggataatccaacttttgcagaagatgaggagttacaaaatatggacaaagaagatgcattaatttgctttgaagaacacattcgggctttagaaaaggaggaagaagaagaaaaacagaagagtttgctgagagaaaggagacgacagcgaaaaaatagggaatctttccagatatttttagatgaattacatgaacatggacaactgcattctatgtcatcttggatggaattgtatccaactattagttctgatattagattcactaatatgcttggtcagcctggatcaactgcacttgatcttttcaagttttatgttgaggatcttaaagcacgttatcatgacgagaagaagataataaaagacattctaaaggataaaggatttgtagttgaagtaaacactacttttgaagattttgtggcgataatcagttcaactaaaagatcaactacattagatgctggaaatatcaaattggctttcaatagtttactagaaaaggcagaagcccgtgaacgtgaaagagaaaaagaagaggctcggaagatgaaacgaaaagaatctgcatttaagagtatgttaaaacaagctgctcctccgatagaattggatgctgtctgggaagatatccgtgagagatttgtaaaagagccagcatttgaggacataactctagaatctgaaagaaaacgaatatttaaagattttatgcatgtgcttgagcatgaatgtcagcatcatcattcaaagaacaagaaacattctaagaaatctaaaaaacatcataggaaacgttcccgctctcgatcggggtcagattcagatgatgatgatagccattcaaagaaaaaaagacagcgatcagagtctcgttctgcttcagaacattcttctagtgcagagtctgagagaagttataaaaagtcaaaaaagcataagaagaaaagtaagaagaggagacataaatctgactctccagaatccgatgctgagcgagagaaggataaaaaagaaaaagatcgggaaagtgaaaaagacagaactagacaaagatcagaatcaaaacacaaatcgcctaagaaaaagactggaaaggattctggtaattgggatacttctggcagcgaactgagtgaaggggaattggaaaagcgcagaagaacccttttggagcaactggatgatgatcaataaattataccaaatatatgtttacagtatgatttaaagtctgattcagaccagggactctattttaagttcaactgaaataacactgggttttaattatatcacaggaaaaaaaaagtgcatttaagtattgttatcgtggactttataaaagcaaaggaaattgaaagtaacttttgattctgtatcaagaatcatattttcatacagtcataactgtctttctgtgaccctttcacagggcactgtaggatggattaaaggtggcaatttactgataactgcagatgtctctactttgttctaaaatctaagtcatgaggtgatttgatttactttatagaagctggattttgaagatctaatgaaaaattttttgataatatagtagtacaaaaaaagcaccagcaactgataaaaattgcttttttgtgcgctacccaactggttaaagccaatgtgatcttttatggtgaaactcctaagaaacaggtggttttgctggaaacttggtagacccttaattatagtggtgctaatgagcactactgtaatataaagccaccattattttttatcaaacatctgaatacattttacaaaggctattgtgagggcattattttgagcatctattttgaggtgatgtttaaaaaaactttaacatcaaatcaaattgtaaattaatttaaatatattgccttaaggacctactaaagaatgtgccaccagactttaagtgatagttgcaatatccttgtctaaaaaaaaaaaaaaagttgacttaaacattttctttaacagttgtcttttttttctaaattcagtctttctcttgcttttttttccctgctattgaggaagtattttgccttccctactcactgagaagtattgacttcgtggtacacattctaaagcatttctgatttgaatatttttgtacatttttatcaattattaaaccttctcttctagtgtgtactagtatttatttctacttaaactgctcagctctaaagaaattgtatgatcactttaaaggtactaaatccctgaaattttgcttcatcttacccacaccgctagtttactttccttttttaatatttaagaatattataaatcagtgcatttgaggtccctagatttgtttttcacctatgaattttttacagactattttagagaggctgtggtttgaagacagaatactctttacatgctaacttttgaaggttggtaatgtaatttatactattttccttcagtgcaggagattttttaagtaaataagtaaattttagcacctattcttcggtattatctgtgttattcttttaatgtgtacacttgaagagatcctatttcaaagttgggattttgaagaacaaaaagtttttttcttacccatcctagtgagttttgaaagtgggcctgaccagaatgtctctttcccattttgccccgtttgaattaaatataatgtctactctttaaaggctgaaggggtgggtgaggggattgtttctcattttgtctcccaagtcatttttctgctgtgaaatatgaccaggcttgtaggaagactcatcttggagaaaatgtgaagtaatcaaattgcttgagattagtctcctattgtatattagagccaaaacacataataactttggcaacagggagttgtctagactcaattttcagaggtcccattgtagtgagttaatattgctaatcatgtcaatcacttgacatggaagtcagtggcaaatctttaaagtatgcatttgatactggcaaatatatactactgatgtttcacaaaagaatcttagaatctgtagaaaacattaattacttccatgaattatttctaaagtataactttaaagttttgatttttctatttaaataaaaagctattgatgtgttttagcatgtcctcaaaatagattcctgtatttcttacagagataatcttactataaccgcaaatccctacaacacagtataaagtttccctgtagttcacccatgaaaattatttgacttaaaaacaaccatagtagtaagccaattgcaattcaaaatgcaacatccttgccataaaagatgtaacttaagtgactgtgatcctttgtctacctttcaggatcccatcaaatgggatttagttgctagaaagatacttgacagtctgaaggcacaggtgataagattttgttctctgtgaatatttttaaactaataggttatgtttttaaatcttcaatttggtaaaaaactgaaacgtcttggaatattggttctattagagttaaatatggtaaaacaggaaagcgtgtttattttcagataaggggaatttatacttttcattaaagtcttggagtcttaggaaaatgttgagggtttgtcttcccccagtgtcattaatactaatgaactattagatcaaattcacttatacatttaatatcatagttattcaaaatcaggactttaaatatttttttctcccagttcatatttctttgtgcgaaaattgaatttgtatgaaaagttagataattaagctaatcaagtatgaagtatacactcttcctaagtgaatttaaataatgtaatgcttttaaataaaagcagtggtcccaccacatttttttcagcatagtagctggcattttgttatcattagccagagtagcttcagcatataagttattgatgttttccaacttcaaaagtgcattttatgcctcccagtaaatttgataatgatttgtcacagctttgtcatcttttgacttttgcttatgggcctcacttcgtacaactataacatgaaaaaggattgtcctaaagtaagggaatcagttaatggtaggatgaagaaactgtaaaaactcctagaaaaaaacctgtgtgcatttttctggaaagttttcaaactgtgtaattcagttttcattcaattatataatttggttatatgctttaaaaaacatttgtctaaatgttcccggttttcttctggtcttagagtcagctgagtgctggctatgcagccactcgtatttttgcatccagaaaggagtaactccctttatatgaagatttttttttttaagcttagatgctatgtaagagaaaactatttgtaatcacatagtacccagggaggagtgatgaatgcttttttaaaaaaggatatttaagtatattatgtaatttaaatataaattatcaaactaaaaaacttcagcttttaaaactttctaaacaaaatgaagcaaagtacattaattccttctatcttaaatctgagactttttattttcccttgggtatatatttctctcagtgttaggtagatgttaattcaaccatcctacattctctatataaaattacactcattttacatgaaagcaaaataatgtcgttactttcatggaactgtgttctaacaggcttataatctcattctgtgcttctggtaatggcgtataccagtctgatgattcttaccatccttattcttacattactcttccaattgttttgattttaactggtggtcatgtaagttcctcggtggcagggatttatctggttcatttactgttatatatccttgtggaataggacagtgcctggcatataataggcacttttggaatgaatgtaaaatactagttgaaatatgtattcatctggcatccatggtacccatcatctgtattaaagggcttaaaaaagcatcattgcaataaaccatactaacccaccactaaagtcacagtcataattgaagtgcacccaaaataaggtccagtgactgtaccttagcttttacttcagacatgtccaaaacttgtgagaacatacaatttaaagttgaaaactcatcattttgggctatttttgaatagggctgaaatatggtgacatgtcaggcactcagttttttggagctgtcttaaaggtgaggtggaaagtgagagatgattttgctctaattacccacacattctccctaaccctccattttaagacacttagctataatagcttaagactatcaaaactgcttttgtgattctcagtaggatctagttcaaagccatctcagtgctagtgattggtaattgttaatttgatggtaattaccctacttgtaaagttgacattcatactggctaatcctccctgcccctagtcgtggacaatgaaacagtgagtggctggtgaattagatcagattcaaactaagccattccttgatgctattcttcactgctgttccttagggtatctaaatgtgttatttataaacatttttgggggctcctgcctgcaaacttcggtaggtgttggtcttccccacctctacaactgagccaaggacttgttctgaaaggtgagtaataaataagggaacaaggtttctattttctgtgtttgtaattaccagattttcacctctgtttatatattattctgatgtaaaagaacctcatagttatataaaattagaccttttgtaaataaatataatttattagaaaaaatggtatcttttactaaattggatttgtgtcagttttttcctttaagcaccactcaggcagcaagctctatgctgtgagagttgctggaggcccacgttatgttttctcagtgtaattcctctttttcttgataaaaaga

SEQ ID NO: 172268 - DNA, 490 bp, Homo sapiens
  Payload ID: 13869
  Gene Symbol: PRPF40A
  Gene Name: PRP40 pre-mRNA processing factor 40 homolog A
  ENST ID: ENST00000448428
  CDS Start-End: 1-490
agatcgcttcttgttggtatgtgtagcggcagtggccgccggcggagcagtctgagcccgacgatgaggccggggacgggagctgagcgtggaggcctcatgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatg

SEQ ID NO: 172269 - DNA, 1043 bp, Homo sapiens
  Payload ID: 13869
  Gene Symbol: PRPF40A
  Gene Name: PRP40 pre-mRNA processing factor 40 homolog A
  ENST ID: ENST00000493468
  CDS Start-End: 1-1041
gagcgtggaggcctcatggtgagtgaaatggagagccatcctccctcgcagggtcctggggacggggagcggagattgtccggctcaagcctctgctccggctcttgggtctctgctgacggcttcctgaggagacggccctcgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaagcaatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgagtaagt

SEQ ID NO: 172270 - DNA, 1358 bp, Homo sapiens
  Payload ID: 13869
  Gene Symbol: PRPF40A
  Gene Name: PRP40 pre-mRNA processing factor 40 homolog A
  ENST ID: ENST00000545856
  CDS Start-End: 14-1358
tctgagcccgacgatgaggccggggacgggagctgagcgtggaggcctcatggtgagtgaaatggagagccatcctccctcgcagggtcctggggacggggagcggagattgtccggctcaagcctctgctccggctcttgggtctctgctgacggcttcctgaggagacggccctcgatggggcaccctggcatgcattatgccccaatgggaatgcaccctatgggtcagagagcgaatatgcctcctgtacctcatggaatgatgccgcagatgatgccccctatgggagggccaccaatgggacaaatgcctggaatgatgtcgtcagtaatgcctggaatgatgatgtctcatatgtctcaggcttccatgcagcctgccttaccgccaggagtaaatagtatggatgtagcagcaggtacagcatctggtgcaaaatcaatgtggactgaacataaatcacctgatggaaggacttactactacaacactgaaaccaaacagtctacctgggagaaaccagatgatcttaaaacacctgctgagcaactcttatctaaatgcccctggaaggaatacaaatcagattctggaaagccttactattataattctcaaacaaaagaatctcgctgggccaaacctaaagaacttgaggatcttgaaggataccagaataccattgttgctggaagtcttattacaaaatcaaacctgcatgcaatgatcaaagctgaagaaagcagtaagcaagaagagtgcaccacaacatcaacagccccagtccctacaacagaaattccgaccacaatgagcaccatggctgctgccgaagcagcagctgctgttgttgcagcagcagcagcggcagcagcagcagcagctgcagccaatgctaatgcttccacttctgcttctaatactgtcagtggaactgttccagttgttcctgagcctgaagttacttccattgttgctactgttgtagataatgagaatacagtaactatttcaactgaggaacaagcacaacttactagtacccctgctattcaggatcaaagtgtggaagtatccagtaatactggagaagaaacatctaagcaagaaactgtagctgattttactcccaaaaaagaagaggaggagagccaaccagcaaagaaaacatacacttggaatacaaaggaagaggcaaagcaagcttttaaagaattattgaaagaaaagcgggtaccatcgaatgcttcatgggagcaggctatgaaaatgattattaatgatccacgatacagtgctttggcaaagttaagtgaaaaaaagcaagcctttaatgcctataaagtccagacag

SEQ ID NO: 172271 - DNA, 2043 bp, Homo sapiens
  Payload ID: 13870
  Gene Symbol: PRR5-ARHGAP8
  Gene Name: PRR5-ARHGAP8 readthrough
  ENST ID: ENST00000352766
  CDS Start-End: 1-1932
atgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgagggacagaagctgctggactcactggcagagacctgggacttcttcttcagtgacgtgctgcccatgctgcaggccatcttctacccggtgcagggcaaggagccatcggtgcgccagctggccctgctgcacttccggaatgccatcaccctcagtgtgaagctagaggatgcgctggcccgggcccatgcccgtgtgccccctgccatcgtgcagatgctgctggtgctgcagggggtacatgagtccaggggcgtgactgaggactacctgcgcctggagacgctggtccagaaggtggtgtcgccatacctgggcacctacggcctccactccagcgaggggcccttcacccattcctgcatcctggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcatctgtaaaaataaccagccattagatgaattcagaa

SEQ ID NO: 172272 - DNA, 2013 bp, Homo sapiens
  Payload ID: 13870
  Gene Symbol: PRR5-ARHGAP8
  Gene Name: PRR5-ARHGAP8 readthrough
  ENST ID: ENST00000361473
  CDS Start-End: 243-1937
ccgcgcgcctggcgctccacgctgagcctctccgtgcaatgattaacccggcggggcggccggcgcgggacccgagacggaggcgcggggccggggcgggaccccgcaggaccgctcggcttcctgctctcgccggagtttccgcgtagagggcgcatcgccggcccggggcccttggtgcggcgtggcgcagggcgcggcgtggggcgcgcgtgggcgcggcgcaggcggcccgggtcaccatgaggactctccgcaggttgaagttcatgagttcgcccagcctcagtgacctgggcaagagagagccggccgccgccgcggacgagcggggcacgcagcagcgccgggcctgcgccaacgccacctggaacagcatccacaacggggtgatcgccgtcttccagcgcaaggggctgcccgaccaggagctcttcagcctcaacgagggcgtccggcagctgttgaagacagagctggggtccttcttcacggagtacctgcagaaccagctgctgacaaaaggcatggtgatccttcgggacaagattcgcttctatgaggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctgtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcat

SEQ ID NO: 172273 - DNA, 1590 bp, Homo sapiens
  Payload ID: 13870
  Gene Symbol: PRR5-ARHGAP8
  Gene Name: PRR5-ARHGAP8 readthrough
  ENST ID: ENST00000515632
  CDS Start-End: 1-1514
agctggggtccttcttcacggagtacctgcagaaccagctgctgacaaaaggcatggtgatccttcgggacaagattcgcttctatgaggagctgcagagagacaaggcggcggcggctgctgtgctgggtgcagtgaggaagaggccctcggtggtgcccatggctggccaggatcctgcgctgagcacgagtcacccgttctacgacgtggccagacatggcattctgcaggtggcaggggatgaccgctttggaagacgtgttgtcacgttcagctgctgccggatgccaccctcccacgagctggaccaccagcggctgctggagtatttgaagtacacactggaccaatacgttgagaacgattataccatcgtctatttccactacgggctgaacagccggaacaagccttccctgggctggctccagagcgcatacaaggagttcgataggaagtacaagaagaacttgaaggccctctacgtggtgcaccccaccagcttcatcaaggtcctgtggaacatcttgaagcccctcatcagtcacaagtttgggaagaaagtcatctatttcaactacctgagtgagctccacgaacaccttaaatacgaccagctggtcatccctcccgaagttttgcggtacgatgagaagctccagagcctgcacgagggccggacgccgcctcccaccaagacaccaccgccgcggcccccgctgcccacacagcagtttggcgtcagtctgcaatacctcaaagacaaaaatcaaggcgaactcatcccccctgtgctgaggttcacagtgacgtacctgagagagaaaggcctgcgcaccgagggcctgttccggagatccgccagcgtgcagaccgtccgcgagatccagaggctctacaaccaagggaagcccgtgaactttgacgactacggggacattcacatccctgccgtgatcctgaagaccttcctgcgagagctgccccagccgcttctgaccttccaggcctacgagcagattctcgggatcacctcgctgcccctggcccctctggagctcagcagggagccccatgcccttccaggtgtggagagcagcctgcgtgtcactggctgccgccagatcttacggagcctcccagagcacaactacgtcgtcctccgctacctcatgggcttcctgcatgcggtgtcccgggagagcatcttcaacaaaatgaacagctctaacctggcctgtgtcttcgggctgaatttgatctggccatcccagggggtctcctccctgagtgcccttgtgcccctgaacatgttcactgaactgctgatcgagtactatgaaaagatcttcagcaccccggaggcacctggggagcacggcctggcaccatgggaacaggggagcagggcagcccctttgcaggaggctgtgccacggacacaagccacgggcctcaccaagcctaccctacctccgagtcccctgatggcagccagaagacgtctctagtgttgcgaacactctgtatatttcgagctacctcccacacctgtctgtgcacttgtatgttttgtaaacttggcat

SEQ ID NO: 172274 - DNA, 2997 bp, Homo sapiens
  Payload ID: 13871
  Gene Symbol: PRUNE
  Gene Name: prune exopolyphosphatase
  Uniprot ID: Q86TP1
  ENST ID: ENST00000271620
  CDS Start-End: 157-1518
ggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagacaactgaggctgaggaagtctttgtgccagttttaaatataaaacgttctgaactacctctgcgaggtgacattgtcttctttcttcagaaggttcatattccagagagtatcttgatttttcgggatgagattgacctccatgcattataccaggctggccaactcaccctcatccttgtcgaccatcatatcttatccaaaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggcctgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 172275 - DNA, 2214 bp, Homo sapiens
  Payload ID: 13871
  Gene Symbol: PRUNE
  Gene Name: prune exopolyphosphatase
  Uniprot ID: Q86TP1
  ENST ID: ENST00000368934
  CDS Start-End: 81-737
tcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggcctgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctg

SEQ ID NO: 172276 - DNA, 2238 bp, Homo sapiens
  Payload ID: 13871
  Gene Symbol: PRUNE
  Gene Name: prune exopolyphosphatase
  Uniprot ID: Q86TP1
  ENST ID: ENST00000368935
  CDS Start-End: 253-759
ctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaaggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggcctgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 172277 - DNA, 2788 bp, Homo sapiens
  Payload ID: 13871
  Gene Symbol: PRUNE
  Gene Name: prune exopolyphosphatase
  Uniprot ID: Q86TP1
  ENST ID: ENST00000368936
  CDS Start-End: 494-1309
cgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaagaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggcctgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtt

SEQ ID NO: 172278 - DNA, 1850 bp, Homo sapiens
  Payload ID: 13871
  Gene Symbol: PRUNE
  Gene Name: prune exopolyphosphatase
  Uniprot ID: Q86TP1
  ENST ID: ENST00000368937
  CDS Start-End: 221-877
gaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggcctgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttcc

SEQ ID NO: 172279 - DNA, 825 bp, Homo sapiens
  Payload ID: 13871
  Gene Symbol: PRUNE
  Gene Name: prune exopolyphosphatase
  ENST ID: ENST00000450884
  CDS Start-End: 407-825
ggaggccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcagaagtgacacagccctagaggaggcagtagcagaggtgctagaccatcgacccatcgagccgaaacactgccctccctgccatgtttcagttgagctggtggggtcctgtgctaccctggtgaccgagagaatcctgcagggggcaccagagatcttggacaggcaaactgcagcccttctgcatggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggaggcctttctgcagaggtctaacctccttgcagatctccatgctttctgccaggctcacagctatgatgtcctggttgccatgactatctttttcaacactcacaatgagccagtgcggcagttggctattttctgtccccatgtggcactccaaacaacgatctgtgaagtcctggaacgctcccactctcc

SEQ ID NO: 172280 - DNA, 845 bp, Homo sapiens
  Payload ID: 13871
  Gene Symbol: PRUNE
  Gene Name: prune exopolyphosphatase
  ENST ID: ENST00000431193
  CDS Start-End: 310-845
ccgattcgccgtgtggcgggttcgagtcccgcctcctgactctggcctctagtccctgagtcccgggcgggctgcattcgtcggggaaacctctcctcgaccaggggcacctctactcgaccaggggcgacggcgtactttgggcttcatcatggaggactacctgcagggttgtcgagctgctctgcaggagtcccgacctctacatgttgtgctgggaaatgaagcctgtgatttggactccacagtgtctgctcttgccctggctttttacctagcaaaggaaccatcatcctggactgtgtcaacatggaccttaaaattggaaaggcaaccccaaaggacagcaaatatgtggagaaactagaggcccttttcccagacctacccaagagaaatgatatatttgattccctacaaaaggcaaagtttgatgtatcaggactgaccactgagcagatgctgagaaaagaccagaagactatctatagacaaggcgtcaaggtggccattagtgcaatatatatggatttggagatctgtgaagtcctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggcctgagtcaagatgaggaggaccctccgctgcccccgacgcccatgaacag

SEQ ID NO: 172281 - DNA, 2697 bp, Homo sapiens
  Payload ID: 13872
  Gene Symbol: PRUNE2
  Gene Name: prune homolog 2 (Drosophila)
  ENST ID: ENST00000223609
  CDS Start-End: 150-725
atcatgtgaccagaaaatggaggcgaatctgtatttccagttaactgctcagaagagagatgctgaagagctgtagtcgtgcatccttctcaccctccgttagaaagcctcctctcatcctcagaagactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggatactatggggacggtctaaatgccatcattgtgtttgccgcctgttttctgccagacagcagtcgggcggattaccactatgtcatggaaaatcttttcctatatgtaataagtactttcacactacagccgcagagctgagcagttcagcagaccgtatgtcccacaatgcctaaaacattgactatgtttacagaaaaagtttgctgacccctgctctagcaaacgcatcctttcctactccaccccaatttgtatttagatagtttctctaacagaacggacaaatgaggctgcaaactaatttatttttgtcaaaaatcaatgttttgacatccacagacagtgaaataaaagaaatggcttgctgaaaaacatgaggagtcctagccacaaaatcactgcttaggttgcaattgccaaaatgaagccttcttagaagcacttctttagtatatacaggtgttggctgaagtccgtgcctcactctgggaaccattcttagtctccagtgtctcctattacaaagaagctggcagaaataaaaatgaaggggtgagagcggttccaccctagtctcatggtggaaaattcattggggagagctgtccaggatatttggagtcctgggtagaaggagcttgtaactactttaaagtcgacatctttgcacaggtgattgagtttctctgacctcattgcttcacctctgtctcctcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttggtaaataaattctccataatgtagattaataatataaaagtctttaatgacacaatatatctatatagcctcactgtataattcagaaataaaaattgattctgc

SEQ ID NO: 172282 - DNA, 1069 bp, Homo sapiens
  Payload ID: 13872
  Gene Symbol: PRUNE2
  Gene Name: prune homolog 2 (Drosophila)
  ENST ID: ENST00000376713
  CDS Start-End: 123-1019
agggagcagtcggtcgctgcgccccggcgggccactttcccgggaccccgctcgtcttccttgggccgagattttccactgcgcccctccgagtacccgggttccaaacccctagccacgacatggaagaatttttgcaacgcgccaaatctaaactgaatcgaagcaaacgcttggagaaggtccatgtggttattgggcctaaatcgtgtgacttggattctctcatttctaccttcacatatgcttactttctagacaaggtcagtccaccaggggttctgtgtttaccagtgctgaacataccaagaactgaattcaactacttcaccgagacgaggtttattttagaagagctaaatatttccgaatcattccacatattccgggatgaaattaacctgcatcagctaaatgatgaagggaagttatcgataacacttgttggcagcagtgtgctggcgagtgaagacaaaactttagaatcagcagttgtcaaagtcattaatccggttgagcagagcgatgccaacgttgagttccgagagtcttcctcttctctcgtgctaaaggagattctccaagaggctcctgagctcatcaccgagcaactggctcatcgcctcagaggtagcattcttttcaagtggatgaccatggaatcagagaagatctcagagaagcaggaggaaattctttctatcctggaagaaaaatttcctaacttgcctccaagagaggacatcatcaacgtcctacaggagacccagttcagtgctcagggtttaagtattgaacagacaatgttgaaagatctaaaggagctgtcagatggagaaataaaagtggccattagtactgtgagcatgaaccttgagatgagcaggattgagcttttccccaagggcacatggctggtgaatagagacgcctttcaatccaggaactctggctccaaatgcatgcctgggaccactgtgctacagtgcaccttaagaagtttacaaagaggaaagtagtggtttgtgagtttaatgtccagtatatataataactatcaactgaattc

SEQ ID NO: 172283 - DNA, 4308 bp, Homo sapiens
  Payload ID: 13872
  Gene Symbol: PRUNE2
  Gene Name: prune homolog 2 (Drosophila)
  ENST ID: ENST00000376717
  CDS Start-End: 53-1114
gaccagaaaatggaggcgaatctgtatttccagttaactgctcagaagagagatgctgaagagctgtagtcgtgcatccttctcaccctccgttagaaagcctcctctcatcctcagaagactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaaactggatgaagaactgagggaagcatcagaggcagctaaaactagctgcctttacaatgatccagaaatgtcttctatggagaaggatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagtgatactttgtcccttagactggtgtttaccagtaagatacctttaatccactgttaagtatgagtggatttgtttccatagattagctggatttccttttggtgattgcattaggtttaaagtacacaggtctcaactctccccaggaaagtttcccctgtttgactccacctttaaaatcctaagcctgactaggacagccacaaaccacacaaggtgtaaaaccatcatcagctaagtgcccgttttgttcttgtttaccagaatctcctttaacttctcaaagggaagccgggctttctaatccacgtcaactttattttagttgtcaaattgggcattatattttatgtaaattggtcttttaacatcattttcctgatgaatgttggtgaccaccacattgtgaaatttaagaatccgtgttgcatgtttggtagctctctgagtttcaggccataaactcagctccagaggttaccttttaagtgccaagaactcaagtgcaaggtggcctactcaaaaatcatttggtagcattcagttattcatgaattcctctctcgcatgcattataaaaagtgatctgctttaaaacaccgtaatctgatcataggcttaaaattaaatatgagtattactttcatgtacaaaatatttcctttatagtcttcatatgccctttaaaatgccaacaagatttcaagtctgtaggcctctagtgaggtggggtggcaaaccacagctaagtctcgctcaccactgcaagctaagaatggtttttacattttgggttggaaaaattttttttgaatatttcatgacacatgaaaattattcaaatgttagtgccgataaataaagtggtactgaaacacagccacacaaacttgtttttgtactgtctacagctactttcacactacagccgcagagctgagcagttcagcagaccgtatgtcccacaatgcctaaaacattgactatgtttacagaaaaagtttgctgacccctgctctagcaaacgcatcctttcctactccaccccaatttgtatttagatagtttctctaacagaacggacaaatgaggctgcaaactaatttatttttgtcaaaaatcaatgttttgacatccacagacagtgaaataaaagaaatggcttgctgaaaaacatgaggagtcctagccacaaaatcactgcttaggttgcaattgccaaaatgaagccttcttagaagcacttctttagtatatacaggtgttggctgaagtccgtgcctcactctgggaaccattcttagtctccagtgtctcctattacaaagaagctggcagaaataaaaatgaaggggtgagagcggttccaccctagtctcatggtggaaaattcattggggagagctgtccaggatatttggagtcctgggtagaaggagcttgtaactactttaaagtcgacatctttgcacaggtgattgagtttctctgacctcattgcttcacctctgtctcctcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttggtaaataaattctccataatgtagattaataatataaaagtctttaatgacacaatatatctatatagcctcactgtataattcagaaataaaaattgattctgca

SEQ ID NO: 172284 - DNA, 12584 bp, Homo sapiens
  Payload ID: 13872
  Gene Symbol: PRUNE2
  Gene Name: prune homolog 2 (Drosophila)
  Uniprot ID: Q8WUY3
  ENST ID: ENST00000376718
  CDS Start-End: 125-9391
ggagggagcagtcggtcgctgcgccccggcgggccactttcccgggaccccgctcgtcttccttgggccgagattttccactgcgcccctccgagtacccgggttccaaacccctagccacgacatggaagaatttttgcaacgcgccaaatctaaactgaatcgaagcaaacgcttggagaaggtccatgtggttattgggcctaaatcgtgtgacttggattctctcatttctaccttcacatatgcttactttctagacaaggtcagtccaccaggggttctgtgtttaccagtgctgaacataccaagaactgaattcaactacttcaccgagacgaggtttattttagaagagctaaatatttccgaatcattccacatattccgggatgaaattaacctgcatcagctaaatgatgaagggaagttatcgataacacttgttggcagcagtgtgctggcgagtgaagacaaaactttagaatcagcagttgtcaaagtcattaatccggttgagcagagcgatgccaacgttgagttccgagagtcttcctcttctctcgtgctaaaggagattctccaagaggctcctgagctcatcaccgagcaactggctcatcgcctcagaggtagcattcttttcaagtggatgaccatggaatcagagaagatctcagagaagcaggaggaaattctttctatcctggaagaaaaatttcctaacttgcctccaagagaggacatcatcaacgtcctacaggagacccagttcagtgctcagggtttaagtattgaacagacaatgttgaaagatctaaaggagctgtcagatggagaaataaaagtggccattagtactgtgagcatgaaccttgagaattgtctatttcacagcaatattaccagtgacttgaaagcatttacagacaagtttggttttgatgtcctcatcctgttctccagctatctgtcagaggagcagcagccgagacgacagattgctgtgtactcagaaaacatggagctgtgcagtcagatttgctgtgagctggaagagtgtcagaacccttgcctagaactggagccctttgactgtggctgtgatgagatcctggtgtaccaacaagaggacccttcagtgacttgtgatcaggtggttctcgttgtcaaggaagtcatcaacaggaggtgtccagagatggtctccaatagccggacatcctcaacagaagccgtggcaggcagtgcccccctctcccaggggtcttctgggattatggaattgtatggttctgacatagagccacaacccagctctgtgaatttcatagagaaccctccagatctcaatgattctaaccaggctcaggtggatgccaatgtagaccttgttagcccagacagcggactggctaccattaggagcagccgctcatccaaggagagctctgttttcctcagtgacgacagccccgtgggagaaggtgctgggcctcaccacacccttctcccagggcttgactcctacagccccatccctgaaggggcggtggcggaggaacatgcatggtctggagaacacggtgagcacttcgacctcttcaattttgacccagcacccatggcttctgggcagtcccagcaatcttctcattctgcagactactccccagcagatgacttcttccccaacagtgacctgtcagaaggacagctccccgctgggcctgaaggacttgatggcatgggaaccaacatgtctaattattcatccagttcacttttgtcaggggctggcaaagatagccttgtggaacatgatgaggagtttgtccagagacaagacagtcccagagataactctgaaagaaatttgagcctgacagattttgtgggagatgaatccccttccccagaaaggctaaaaaatactggaaagaggatcccaccaacacccatgaatagtttagtagaaagctcgccatccactgaagaaccagcctcactctatacagaagatatgacccaaaaagcaactgacacaggtcacatggggccacctcagacccatgcacggtgcagcagctggtggggtggtttggaaattgactccaaaaatattgcagatgcgtggagttccagtgaacaggaatctgttttccagagccctgaatcatggaaagagcataagccaagctccattgataggagagcctcagattctgtatttcaaccaaagagcctcgaatttacaaagtcaggtccctgggagtctgaatttggtcagcctgaactgggtagcaatgatattcaagacaaaaatgaggaaagcttgccgttccagaacctgcccatggagaagtcacctttgccaaatacatctccccaaggaacaaaccacctgatagaagactttgcttctttgtggcattctggtcgctctcccacagccatgcccgagccctggggaaatcctacagatgatggtgaaccagcagctgtggcgccattcccagcctggagtgcatttggtaaagaagatcatgatgaagctttaaaaaatacctggaatttgcacccaacaagcagcaagacaccttctgttagggacccgaatgagtgggccatggcaaaaagtgggtttgccttttcttcttcagaactactggacaattcacccagtgagataaacaatgaagcagctccagaaatctggggcaagaaaaacaatgactccagggatcacatctttgcacctggaaatcccagttctgatctggatcacacatggactaattctaagccaccaaaagaagatcagaatggtttagtggatcctaaaactaggggcaaggtatatgaaaaggtagattcctggaacctttttgaggagaatatgaagaaaggagggtcagatgtcctagttccttgggaagattccttcttatcttacaaatgttctgattacagtgcatccaacctaggagaagattcggtgccttcccccttagataccaattattccacctcagactcttacacatcaccaacatttgctggagacgaaaaggaaactgaacacaagccatttgctaaagaggaaggttttgagtcaaaagatggtaactccacggcagaggagactgacattcctcctcagtcactgcaacagtcatctcgaaatcgaatcagttcaggtcctgggaacctagacatgtgggcttcacctcatacagataacagttctgaaataaataccactcacaacctggatgaaaatgaactcaagacagagcacacagatggtaagaatatctccatggaggatgacgtcggggaaagcagccagtccagttacgacgaccccagcatgatgcaactgtacaatgaaacaaaccgacaactcacacttttgcacagcagcaccaactcccggcagacggcccctgacagtctcgacttgtggaacagagtgattttggaggatactcagtccactgcaacgatctcagatatggacaatgatttggactgggatgactgcagtgggggtgcggcaatccccagtgatggtcaaacagaaggatacatggctgaaggttccgagccggaaacccgatttacagtgagacagctggaaccctggggcttggagtatcaggaagcaaatcaggtagattgggagctccctgcctctgatgagcataccaaggacagtgctcccagtgaacatcacacattgaatgagaaaagtgggcagctaattgcaaacagtatttgggattctgtcatgagagataaagacatgtcatcattcatgttaccaggctcctcacatatcacagattcagagcaaagggaattgcctcctgaaatccccagccattcagcaaatgttaaagacactcattccccagatgcgccagcagcctctggaaccagtgaatcagaggcacttatatctcatcttgacaagcaggacacagagagggaaaccctgcaaagtgatgcagcatccttggcgactaggcttgagaatccagggtattttccacacccagatccatggaaaggtcatggcgatggacaaagtgaaagtgagaaggaagcccagggagccactgacagggggcaccttgatgaagaggaggtgatcgcctctggtgtggagaatgcctcagggatttctgaaaaagggcagagtgaccaggaactgtcttctctggttgcatctgaacatcaggaaatctgcattaaatcaggcaaaatcagctctcttgctgtcactttcagtcctcaaaccgaggaaccagaggaagttttagagtatgaggaggggtcttacaatctagactcccgtgatgtgcaaacagggatgtccgcagataacctgcagccaaaagatacccatgaaaaacacctcatgagtcaaagaaattcaggtgaaactactgagacttcagatgggatgaatttcacaaaatatgtatctgtacctgaaaaggatcttgagaaaactgaagaatgtaactttctagagccagagaacgtgggtggagggccacctcacagagttccccgaagtcttgattttggggacgtccctatagacagtgatgtgcatgtcagcagcacatgttctgagataaccaaaaatcttgacgttaaggggtctgaaaatagccttccaggagccggttcgtctggaaattttgacagagatactatttctagtgagtatactcattcaagtgcatcaagtcctgagttaaatgactcttcagttgcactgtcctcctggggccagcaacccagttctgggtatcaagaagaaaaccaaggcaactggagtgaacagaatcaccaagaatctgaactaattaccactgatggccaagtagaaatagttaccaaagtgaaggatttagagaaaaacagaataaatgagtttgaaaagagctttgatcgcaaaactcctacatttttagagatctggaatgactcagttgatggtgattccttttcctctttatccagtcctgaaacaggcaaatattctgaacattcagggacacatcaggaaagcaatctaattgctagctaccaggagaaaaatgaacatgacatttctgcaactgtgcagccagaggatgccagggtcatttcaacaagctcaggttctgatgatgacagtgtcggtggtgaagagtcaatagaggaagagatccaggtggccaactgccacgttgctgaggatgaatccagagcttgggattcattgaatgaatctaataagttcttggtcacagctgatcctaagtctgaaaatatttatgactacctagacagctcagagccagcagagaatgagaataagtcaaacccattctgtgacaatcaacaaagcagccctgatccctggactttctcaccattaacggagactgaaatgcagattacagcagtggagaaggagaagagatcttctccagaaacagggacaacaggagatgttgcatggcaaatatctcccaaagcttcgttcccaaagaacgaagataattctcaactggaaatgctgggcttctcagctgatagcactgagtggtggaaggcctcaccccaggaagggagactaattgaaagtccatttgaaagggagctgtctgactccagtggtgtgttggagataaattcttcagtacaccaaaatgccagtccctggggagtaccagttcagggtgatattgagcccgtggaaacacactatactaatccttttagtgacaaccatcagtcaccctttctggaaggtaatgggaagaactcccatgagcaactctggaacattcaaccaaggcagccagacccagatgctgacaagttcagccagcttgtaaaattagaccaaattaaagaaaaggactcaagagagcaaacctttgtgtctgctgctggtgatgagctgactcctgaaacacctacccaagagcagtgtcaggacaccatgctgccagtctgtgatcatccggacacagcctttactcacgcagaggaaaatagttgtgttacatctaatgtttcaactaatgaaggtcaagaaacaaatcagtgggaacaagaaaaatcatacctaggtgagatgacaaattcaagcattgccacagaaaattttcctgctgtcagttctcccacccaactgataatgaagccaggctctgaatgggatggctctaccccaagtgaggactcccgaggtacctttgtgccagatattttacatggcaactttcaagagggtgggcagctggcctctgccgcgcctgacttgtggatagatgctaagaagcccttcagtttgaaagcagatggtgagaatcctgatatcctgacgcactgcgaacatgacagcaattctcaggcttccgacagccctgatatatgtcacgattctgaagcaaagcaagagactgagaagcacctcagtgcttgcatgggacctgaagtggaatccagtgagctttgtctcactgagccagagatagatgaagaacccatttatgagcctggacgggagtttgtcccatccaatgcagaactcgattctgaaaacgcaactgtgctgcctccaattggctatcaagcagacataaagggctcctctcagcccgcctctcataaaggttcacctgaaccttctgaaataaacggtgacaacagtacaggtttacaagtatcagaaaaaggagccagcccagatatggcaccaattttggaaccagttgacagaagaatcccaaggattgaaaatgtggcaactagcatttttgtaactcaccaagagccaactccagaaggtgacggttcttggatatcagacagcttttctcctgaaagtcagcctggtgcaagagctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaatatcagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaagcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttggcactagaggaagcctctggtccagtcagccaatcacagaagagtaagagccgaggcagggctggcccggatgcagttacgttgcaggctgtcacccatgacaatgaatgggaaatgctttcaccacagcctgttcagaaaaacatgatccctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaaactggatgaagaactgagggaagcatcagaggcagctaaaactagctgcctttacaatgatccagaaatgtcttctatggagaaggatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagtgatactttgtcccttagactggtgtttaccagtaagatacctttaatccactgttaagtatgagtggatttgtttccatagattagctggatttccttttggtgattgcattaggtttaaagtacacaggtctcaactctccccaggaaagtttcccctgtttgactccacctttaaaatcctaagcctgactaggacagccacaaaccacacaaggtgtaaaaccatcatcagctaagtgcccgttttgttcttgtttaccagaatctcctttaacttctcaaagggaagccgggctttctaatccacgtcaactttattttagttgtcaaattgggcattatattttatgtaaattggtcttttaacatcattttcctgatgaatgttggtgaccaccacattgtgaaatttaagaatccgtgttgcatgtttggtagctctctgagtttcaggccataaactcagctccagaggttaccttttaagtgccaagaactcaagtgcaaggtggcctactcaaaaatcatttggtagcattcagttattcatgaattcctctctcgcatgcattataaaaagtgatctgctttaaaacaccgtaatctgatcataggcttaaaattaaatatgagtattactttcatgtacaaaatatttcctttatagtcttcatatgccctttaaaatgccaacaagatttcaagtctgtaggcctctagtgaggtggggtggcaaaccacagctaagtctcgctcaccactgcaagctaagaatggtttttacattttgggttggaaaaattttttttgaatatttcatgacacatgaaaattattcaaatgttagtgccgataaataaagtggtactgaaacacagccacacaaacttgtttttgtactgtctacagctactttcacactacagccgcagagctgagcagttcagcagaccgtatgtcccacaatgcctaaaacattgactatgtttacagaaaaagtttgctgacccctgctctagcaaacgcatcctttcctactccaccccaatttgtatttagatagtttctctaacagaacggacaaatgaggctgcaaactaatttatttttgtcaaaaatcaatgttttgacatccacagacagtgaaataaaagaaatggcttgctgaaaaacatgaggagtcctagccacaaaatcactgcttaggttgcaattgccaaaatgaagccttcttagaagcacttctttagtatatacaggtgttggctgaagtccgtgcctcactctgggaaccattcttagtctccagtgtctcctattacaaagaagctggcagaaataaaaatgaaggggtgagagcggttccaccctagtctcatggtggaaaattcattggggagagctgtccaggatatttggagtcctgggtagaaggagcttgtaactactttaaagtcgacatctttgcacaggtgattgagtttctctgacctcattgcttcacctctgtctcctcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttggtaaataaattctccataatgtagattaataatataaaagtctttaatgacacaatatatctatatagcctcactgtataattcagaaataaaaattgattctgc

SEQ ID NO: 172285 - DNA, 7434 bp, Homo sapiens
  Payload ID: 13872
  Gene Symbol: PRUNE2
  Gene Name: prune homolog 2 (Drosophila)
  ENST ID: ENST00000426088
  CDS Start-End: 1-7153
tttccagagccctgaatcatggaaagagcataagccaagctccattgataggagagcctcagattctgtatttcaaccaaagagcctcgaatttacaaagtcaggtccctgggagtctgaatttggtcagcctgaactgggtagcaatgatattcaagacaaaaatgaggaaagcttgccgttccagaacctgcccatggagaagtcacctttgccaaatacatctccccaaggaacaaaccacctgatagaagactttgcttctttgtggcattctggtcgctctcccacagccatgcccgagccctggggaaatcctacagatgatggtgaaccagcagctgtggcgccattcccagcctggagtgcatttggtaaagaagatcatgatgaagctttaaaaaatacctggaatttgcacccaacaagcagcaagacaccttctgttagggacccgaatgagtgggccatggcaaaaagtgggtttgccttttcttcttcagaactactggacaattcacccagtgagataaacaatgaagcagctccagaaatctggggcaagaaaaacaatgactccagggatcacatctttgcacctggaaatcccagttctgatctggatcacacatggactaattctaagccaccaaaagaagatcagaatggtttagtggatcctaaaactaggggcaaggtatatgaaaaggtagattcctggaacctttttgaggagaatatgaagaaaggagggtcagatgtcctagttccttgggaagattccttcttatcttacaaatgttctgattacagtgcatccaacctaggagaagattcggtgccttcccccttagataccaattattccacctcagactcttacacatcaccaacatttgctggagacgaaaaggaaactgaacacaagccatttgctaaagaggaaggttttgagtcaaaagatggtaactccacggcagaggagactgacattcctcctcagtcactgcaacagtcatctcgaaatcgaatcagttcaggtcctgggaacctagacatgtgggcttcacctcatacagataacagttctgaaataaataccactcacaacctggatgaaaatgaactcaagacagagcacacagatggtaagaatatctccatggaggatgacgtcggggaaagcagccagtccagttacgacgaccccagcatgatgcaactgtacaatgaaacaaaccgacaactcacacttttgcacagcagcaccaactcccggcagacggcccctgacagtctcgacttgtggaacagagtgattttggaggatactcagtccactgcaacgatctcagatatggacaatgatttggactgggatgactgcagtgggggtgcggcaatccccagtgatggtcaaacagaaggatacatggctgaaggttccgagccggaaacccgatttacagtgagacagctggaaccctggggcttggagtatcaggaagcaaatcaggtagattgggagctccctgcctctgatgagcataccaaggacagtgctcccagtgaacatcacacattgaatgagaaaagtgggcagctaattgcaaacagtatttgggattctgtcatgagagataaagacatgtcatcattcatgttaccaggctcctcacatatcacagattcagagcaaagggaattgcctcctgaaatccccagccattcagcaaatgttaaagacactcattccccagatgcgccagcagcctctggaaccagtgaatcagaggcacttatatctcatcttgacaagcaggacacagagagggaaaccctgcaaagtgatgcagcatccttggcgactaggcttgagaatccagggtattttccacacccagatccatggaaaggtcatggcgatggacaaagtgaaagtgagaaggaagcccagggagccactgacagggggcaccttgatgaagaggaggtgatcgcctctggtgtggagaatgcctcagggatttctgaaaaagggcagagtgaccaggaactgtcttctctggttgcatctgaacatcaggaaatctgcattaaatcaggcaaaatcagctctcttgctgtcactttcagtcctcaaaccgaggaaccagaggaagttttagagtatgaggaggggtcttacaatctagactcccgtgatgtgcaaacagggatgtccgcagataacctgcagccaaaagatacccatgaaaaacacctcatgagtcaaagaaattcaggtgaaactactgagacttcagatgggatgaatttcacaaaatatgtatctgtacctgaaaaggatcttgagaaaactgaagaatgtaactttctagagccagagaacgtgggtggagggccacctcacagagttccccgaagtcttgattttggggacgtccctatagacagtgatgtgcatgtcagcagcacatgttctgagataaccaaaaatcttgacgttaaggggtctgaaaatagccttccaggagccggttcgtctggaaattttgacagagatactatttctagtgagtatactcattcaagtgcatcaagtcctgagttaaatgactcttcagttgcactgtcctcctggggccagcaacccagttctgggtatcaagaagaaaaccaaggcaactggagtgaacagaatcaccaagaatctgaactaattaccactgatggccaagtagaaatagttaccaaagtgaaggatttagagaaaaacagaataaatgagtttgaaaagagctttgatcgcaaaactcctacatttttagagatctggaatgactcagttgatggtgattccttttcctctttatccagtcctgaaacaggcaaatattctgaacattcagggacacatcaggaaagcaatctaattgctagctaccaggagaaaaatgaacatgacatttctgcaactgtgcagccagaggatgccagggtcatttcaacaagctcaggttctgatgatgacagtgtcggtggtgaagagtcaatagaggaagagatccaggtggccaactgccacgttgctgaggatgaatccagagcttgggattcattgaatgaatctaataagttcttggtcacagctgatcctaagtctgaaaatatttatgactacctagacagctcagagccagcagagaatgagaataagtcaaacccattctgtgacaatcaacaaagcagccctgatccctggactttctcaccattaacggagactgaaatgcagattacagcagtggagaaggagaagagatcttctccagaaacagggacaacaggagatgttgcatggcaaatatctcccaaagcttcgttcccaaagaacgaagataattctcaactggaaatgctgggcttctcagctgatagcactgagtggtggaaggcctcaccccaggaagggagactaattgaaagtccatttgaaagggagctgtctgactccagtggtgtgttggagataaattcttcagtacaccaaaatgccagtccctggggagtaccagttcagggtgatattgagcccgtggaaacacactatactaatccttttagtgacaaccatcagtcaccctttctggaaggtaatgggaagaactcccatgagcaactctggaacattcaaccaaggcagccagacccagatgctgacaagttcagccagcttgtaaaattagaccaaattaaagaaaaggactcaagagagcaaacctttgtgtctgctgctggtgatgagctgactcctgaaacacctacccaagagcagtgtcaggacaccatgctgccagtctgtgatcatccggacacagcctttactcacgcagaggaaaatagttgtgttacatctaatgtttcaactaatgaaggtcaagaaacaaatcagtgggaacaagaaaaatcatacctaggtgagatgacaaattcaagcattgccacagaaaattttcctgctgtcagttctcccacccaactgataatgaagccaggctctgaatgggatggctctaccccaagtgaggactcccgaggtacctttgtgccagatattttacatggcaactttcaagagggtgggcagctggcctctgccgcgcctgacttgtggatagatgctaagaagcccttcagtttgaaagcagatggtgagaatcctgatatcctgacgcactgcgaacatgacagcaattctcaggcttccgacagccctgatatatgtcacgattctgaagcaaagcaagagactgagaagcacctcagtgcttgcatgggacctgaagtggaatccagtgagctttgtctcactgagccagagatagatgaagaacccatttatgagcctggacgggagtttgtcccatccaatgcagaactcgattctgaaaacgcaactgtgctgcctccaattggctatcaagcagacataaagggctcctctcagcccgcctctcataaaggttcacctgaaccttctgaaataaacggtgacaacagtacaggtttacaagtatcagaaaaaggagccagcccagatatggcaccaattttggaaccagttgacagaagaatcccaaggattgaaaatgtggcaactagcatttttgtaactcaccaagagccaactccagaaggtgacggttcttggatatcagacagcttttctcctgaaagtcagcctggtgcaagagctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaatatcagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaagcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttggcactagaggaagcctctggtccagtcagccaatcacagaagagtaagagccgaggcagggctggcccggatgcagttacgttgcaggctgtcacccatgacaatgaatgggaaatgctttcaccacagcctgttcagaaaaacatgatccctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggagattcaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagt

SEQ ID NO: 172286 - DNA, 903 bp, Homo sapiens
  Payload ID: 13872
  Gene Symbol: PRUNE2
  Gene Name: prune homolog 2 (Drosophila)
  ENST ID: ENST00000424866
  CDS Start-End: 1-783
attgacatcaatgtggatgaacttgatacccccgatgaagcagattcttttgagtacactggccatgatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggagattcaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaagtacgatgaagagagatcttataagagaagtgtgagaactagctgcctttacaatgatccagaaatgtcttctatggagaaggatattgacttgaagctgaaagaaaagccttagttggccatgctggaagaagaggatgcttttctggttcatggttctgttgaaacatatctacctgaaagagacagggctgatgttacctttttccactttgcactacctggtgccattcta

SEQ ID NO: 172287 - DNA, 12356 bp, Homo sapiens
  Payload ID: 13872
  Gene Symbol: PRUNE2
  Gene Name: prune homolog 2 (Drosophila)
  ENST ID: ENST00000443509
  CDS Start-End: 79-9267
accccgctcgtcttccttgggccgagattttccactgcgcccctccgagtacccgggttccaaacccctagccacgacatggaagaatttttgcaacgcgccaaatctaaactgaatcgaagcaaacgcttggagaaggtccatgtggttattgggcctaaatcgtgtgacttggattctctcatttctaccttcacatatgcttactttctagacaaggtcagtccaccaggggttctgtgtttaccagtgctgaacataccaagaactgaattcaactacttcaccgagacgaggtttattttagaagagctaaatatttccgaatcattccacatattccgggatgaaattaacctgcatcagctaaatgatgaagggaagttatcgataacacttgttggcagcagtgtgctggcgagtgaagacaaaactttagaatcagcagttgtcaaagtcattaatccggttgagcagagcgatgccaacgttgagttccgagagtcttcctcttctctcgtgctaaaggagattctccaagaggctcctgagctcatcaccgagcaactggctcatcgcctcagaggtagcattcttttcaagtggatgaccatggaatcagagaagatctcagagaagcaggaggaaattctttctatcctggaagaaaaatttcctaacttgcctccaagagaggacatcatcaacgtcctacaggagacccagttcagtgctcagggtttaagtattgaacagacaatgttgaaagatctaaaggagctgtcagatggagaaataaaagtggccattagtactgtgagcatgaaccttgagaattgtctatttcacagcaatattaccagtgacttgaaagcatttacagacaagtttggttttgatgtcctcatcctgttctccagctatctgtcagaggagcagcagccgagacgacagattgctgtgtactcagaaaacatggagctgtgcagtcagatttgctgtgagctggaagagtgtcagaacccttgcctagaactggagccctttgactgtggctgtgatgagatcctggtgtaccaacaagaggacccttcagtgacttgtgatcaggtggttctcgttgtcaaggaagtcatcaacaggaggtgtccagagatggtctccaatagccggacatcctcaacagaagccgtggcaggcagtgcccccctctcccaggggtcttctgggattatggaattgtatggttctgacatagagccacaacccagctctgtgaatttcatagagaaccctccagatctcaatgattctaaccaggctcaggtggatgccaatgtagaccttgttagcccagacagcggactggctaccattaggagcagccgctcatccaaggagagctctgttttcctcagtgacgacagccccgtgggagaaggtgctgggcctcaccacacccttctcccagggcttgactcctacagccccatccctgaaggggcggtggcggaggaacatgcatggtctggagaacacggtgagcacttcgacctcttcaattttgacccagcacccatggcttctgggcagtcccagcaatcttctcattctgcagactactccccagcagatgacttcttccccaacagtgacctgtcagaaggacagctccccgctgggcctgaaggacttgatggcatgggaaccaacatgtctaattattcatccagttcacttttgtcaggggctggcaaagatagccttgtggaacatgatgaggagtttgtccagagacaagacagtcccagagataactctgaaagaaatttgagcctgacagattttgtgggagatgaatccccttccccagaaaggctaaaaaatactggaaagaggatcccaccaacacccatgaatagtttagtagaaagctcgccatccactgaagaaccagcctcactctatacagaagatatgacccaaaaagcaactgacacaggtcacatggggccacctcagacccatgcacggtgcagcagctggtggggtggtttggaaattgactccaaaaatattgcagatgcgtggagttccagtgaacaggaatctgttttccagagccctgaatcatggaaagagcataagccaagctccattgataggagagcctcagattctgtatttcaaccaaagagcctcgaatttacaaagtcaggtccctgggagtctgaatttggtcagcctgaactgggtagcaatgatattcaagacaaaaatgaggaaagcttgccgttccagaacctgcccatggagaagtcacctttgccaaatacatctccccaaggaacaaaccacctgatagaagactttgcttctttgtggcattctggtcgctctcccacagccatgcccgagccctggggaaatcctacagatgatggtgaaccagcagctgtggcgccattcccagcctggagtgcatttggtaaagaagatcatgatgaagctttaaaaaatacctggaatttgcacccaacaagcagcaagacaccttctgttagggacccgaatgagtgggccatggcaaaaagtgggtttgccttttcttcttcagaactactggacaattcacccagtgagataaacaatgaagcagctccagaaatctggggcaagaaaaacaatgactccagggatcacatctttgcacctggaaatcccagttctgatctggatcacacatggactaattctaagccaccaaaagaagatcagaatggtttagtggatcctaaaactaggggcaaggtatatgaaaaggtagattcctggaacctttttgaggagaatatgaagaaaggagggtcagatgtcctagttccttgggaagattccttcttatcttacaaatgttctgattacagtgcatccaacctaggagaagattcggtgccttcccccttagataccaattattccacctcagactcttacacatcaccaacatttgctggagacgaaaaggaaactgaacacaagccatttgctaaagaggaaggttttgagtcaaaagatggtaactccacggcagaggagactgacattcctcctcagtcactgcaacagtcatctcgaaatcgaatcagttcaggtcctgggaacctagacatgtgggcttcacctcatacagataacagttctgaaataaataccactcacaacctggatgaaaatgaactcaagacagagcacacagatggtaagaatatctccatggaggatgacgtcggggaaagcagccagtccagttacgacgaccccagcatgatgcaactgtacaatgaaacaaaccgacaactcacacttttgcacagcagcaccaactcccggcagacggcccctgacagtctcgacttgtggaacagagtgattttggaggatactcagtccactgcaacgatctcagatatggacaatgatttggactgggatgactgcagtgggggtgcggcaatccccagtgatggtcaaacagaaggatacatggctgaaggttccgagccggaaacccgatttacagtgagacagctggaaccctggggcttggagtatcaggaagcaaatcaggtagattgggagctccctgcctctgatgagcataccaaggacagtgctcccagtgaacatcacacattgaatgagaaaagtgggcagctaattgcaaacagtatttgggattctgtcatgagagataaagacatgtcatcattcatgttaccaggctcctcacatatcacagattcagagcaaagggaattgcctcctgaaatccccagccattcagcaaatgttaaagacactcattccccagatgcgccagcagcctctggaaccagtgaatcagaggcacttatatctcatcttgacaagcaggacacagagagggaaaccctgcaaagtgatgcagcatccttggcgactaggcttgagaatccagggtattttccacacccagatccatggaaaggtcatggcgatggacaaagtgaaagtgagaaggaagcccagggagccactgacagggggcaccttgatgaagaggaggtgatcgcctctggtgtggagaatgcctcagggatttctgaaaaagggcagagtgaccaggaactgtcttctctggttgcatctgaacatcaggaaatctgcattaaatcaggcaaaatcagctctcttgctgtcactttcagtcctcaaaccgaggaaccagaggaagttttagagtatgaggaggggtcttacaatctagactcccgtgatgtgcaaacagggatgtccgcagataacctgcagccaaaagatacccatgaaaaacacctcatgagtcaaagaaattcaggtgaaactactgagacttcagatgggatgaatttcacaaaatatgtatctgtacctgaaaaggatcttgagaaaactgaagaatgtaactttctagagccagagaacgtgggtggagggccacctcacagagttccccgaagtcttgattttggggacgtccctatagacagtgatgtgcatgtcagcagcacatgttctgagataaccaaaaatcttgacgttaaggggtctgaaaatagccttccaggagccggttcgtctggaaattttgacagagatactatttctagtgagtatactcattcaagtgcatcaagtcctgagttaaatgactcttcagttgcactgtcctcctggggccagcaacccagttctgggtatcaagaagaaaaccaaggcaactggagtgaacagaatcaccaagaatctgaactaattaccactgatggccaagtagaaatagttaccaaagtgaaggatttagagaaaaacagaataaatgagtttgaaaagagctttgatcgcaaaactcctacatttttagagatctggaatgactcagttgatggtgattccttttcctctttatccagtcctgaaacaggcaaatattctgaacattcagggacacatcaggaaagcaatctaattgctagctaccaggagaaaaatgaacatgacatttctgcaactgtgcagccagaggatgccagggtcatttcaacaagctcaggttctgatgatgacagtgtcggtggtgaagagtcaatagaggaagagatccaggtggccaactgccacgttgctgaggatgaatccagagcttgggattcattgaatgaatctaataagttcttggtcacagctgatcctaagtctgaaaatatttatgactacctagacagctcagagccagcagagaatgagaataagtcaaacccattctgtgacaatcaacaaagcagccctgatccctggactttctcaccattaacggagactgaaatgcagattacagcagtggagaaggagaagagatcttctccagaaacagggacaacaggagatgttgcatggcaaatatctcccaaagcttcgttcccaaagaacgaagataattctcaactggaaatgctgggcttctcagctgatagcactgagtggtggaaggcctcaccccaggaagggagactaattgaaagtccatttgaaagggagctgtctgactccagtggtgtgttggagataaattcttcagtacaccaaaatgccagtccctggggagtaccagttcagggtgatattgagcccgtggaaacacactatactaatccttttagtgacaaccatcagtcaccctttctggaaggtaatgggaagaactcccatgagcaactctggaacattcaaccaaggcagccagacccagatgctgacaagttcagccagcttgtaaaattagaccaaattaaagaaaaggactcaagagagcaaacctttgtgtctgctgctggtgatgagctgactcctgaaacacctacccaagagcagtgtcaggacaccatgctgccagtctgtgatcatccggacacagcctttactcacgcagaggaaaatagttgtgttacatctaatgtttcaactaatgaaggtcaagaaacaaatcagtgggaacaagaaaaatcatacctaggtgagatgacaaattcaagcattgccacagaaaattttcctgctgtcagttctcccacccaactgataatgaagccaggctctgaatgggatggctctaccccaagtgaggactcccgaggtacctttgtgccagatattttacatggcaactttcaagagggtgggcagctggcctctgccgcgcctgacttgtggatagatgctaagaagcccttcagtttgaaagcagatggtgagaatcctgatatcctgacgcactgcgaacatgacagcaattctcaggcttccgacagccctgatatatgtcacgattctgaagcaaagcaagagactgagaagcacctcagtgcttgcatgggacctgaagtggaatccagtgagctttgtctcactgagccagagatagatgaagaacccatttatgagcctggacgggagtttgtcccatccaatgcagaactcgattctgaaaacgcaactgtgctgcctccaattggctatcaagcagacataaagggctcctctcagcccgcctctcataaaggttcacctgaaccttctgaaataaacggtgacaacagtacaggtttacaagtatcagaaaaaggagccagcccagatatggcaccaattttggaaccagttgacagaagaatcccaaggattgaaaatgtggcaactagcatttttgtaactcaccaagagccaactccagaaggtgacggttcttggatatcagacagcttttctcctgaaagtcagcctggtgcaagagctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaatatcagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaagcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttggcactagaggaagcctctggtccagtcagccaatcacagaagagtaagagccgaggcagggctggcccggatgcagttacgttgcaggctgtcacccatgacaatgaatgggaaatgctttcaccacagcctgttcagaaaaacatgatccctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggagattcaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagtgatactttgtcccttagactggtgtttaccagtaagatacctttaatccactgttaagtatgagtggatttgtttccatagattagctggatttccttttggtgattgcattaggtttaaagtacacaggtctcaactctccccaggaaagtttcccctgtttgactccacctttaaaatcctaagcctgactaggacagccacaaaccacacaaggtgtaaaaccatcatcagctaagtgcccgttttgttcttgtttaccagaatctcctttaacttctcaaagggaagccgggctttctaatccacgtcaactttattttagttgtcaaattgggcattatattttatgtaaattggtcttttaacatcattttcctgatgaatgttggtgaccaccacattgtgaaatttaagaatccgtgttgcatgtttggtagctctctgagtttcaggccataaactcagctccagaggttaccttttaagtgccaagaactcaagtgcaaggtggcctactcaaaaatcatttggtagcattcagttattcatgaattcctctctcgcatgcattataaaaagtgatctgctttaaaacaccgtaatctgatcataggcttaaaattaaatatgagtattactttcatgtacaaaatatttcctttatagtcttcatatgccctttaaaatgccaacaagatttcaagtctgtaggcctctagtgaggtggggtggcaaaccacagctaagtctcgctcaccactgcaagctaagaatggtttttacattttgggttggaaaaattttttttgaatatttcatgacacatgaaaattattcaaatgttagtgccgataaataaagtggtactgaaacacagccacacaaacttgtttttgtactgtctacagctactttcacactacagccgcagagctgagcagttcagcagaccgtatgtcccacaatgcctaaaacattgactatgtttacagaaaaagtttgctgacccctgctctagcaaacgcatcctttcctactccaccccaatttgtatttagatagtttctctaacagaacggacaaatgaggctgcaaactaatttatttttgtcaaaaatcaatgttttgacatccacagacagtgaaataaaagaaatggcttgctgaaaaacatgaggagtcctagccacaaaatcactgcttaggttgcaattgccaaaatgaagccttcttagaagcacttctttagtatatacaggtgttggctgaagtccgtgcctcactctgggaaccattcttagtctccagtgtctcctattacaaagaagctggcagaaataaaaatgaaggggtgagagcggttccaccctagtctcatggtggaaaattcattggggagagctgtccaggatatttggagtcctgggtagaaggagcttgtaactactttaaagtcgacatctttgcacaggtgattgagtttctctgacctcattgcttcacctctgtctcctcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttgg

SEQ ID NO: 172288 - DNA, 12437 bp, Homo sapiens
  Payload ID: 13872
  Gene Symbol: PRUNE2
  Gene Name: prune homolog 2 (Drosophila)
  ENST ID: ENST00000428286
  CDS Start-End: 1156-9348
accccgctcgtcttccttgggccgagattttccactgcgcccctccgagtacccgggttccaaacccctagccacgacatggaagaatttttgcaacgcgccaaatctaaactgaatcgaagcaaacgcttggagaaggtccatgtggttattgggcctaaatcgtgtgacttggattctctcatttctaccttcacatatgcttactttctagacaaggtcagtccaccaggggttctgtgtttaccagtgctgaacataccaagaactgaattcaactacttcaccgagacgaggtttattttagaagagctaaatatttccgaatcattccacatattccgggatgaaattaacctgcatcagctaaatgatgaagggaagttatcgataacacttgttggcagcagtgtgctggcgagtgaagacaaaactttagaatcagcagttgtcaaagtcattaatccggttgagcagagcgatgccaacgttgagttccgagagtcttcctcttctctcgtgctaaaggagattctccaagaggctcctgagctcatcaccgagcaactggctcatcgcctcagaggtagcattcttttcaagtggatgaccatggaatcagagaagatctcagagaagcaggaggaaattctttctatcctggaagaaaaatttcctaacttgcctccaagagaggacatcatcaacgtcctacaggagacccagttcagtgctcagggtttaagtattgaacagacaatgttgaaagatctaaaggagctgtcagatggagaaataaaagtggccattagtactgtgagcatgaaccttgagaattgtctatttcacagcaatattaccagtgacttgaaagcatttacagacaagtttggttttgatgtcctcatcctgttctccagctatctgtcagaggagcagcagccgagacgacagattgctgtgtactcagaaaacatggagctgtgcagtcagatttgctgtgagctggaagagtgtcagaacccttgcctagaactggagccctttgactgtggctgtgatgagatcctggtgtaccaacaagaggacccttcagtgacttgtgatcaggtggttctcgttgtcaaggaagtcatcaacaggaggtgtccagagatggtctccaatagccggacatcctcaacagaagccgtggcaggcagtgcccccctctcccaggggtcttctgggattatggaattgtatggttctgacatagagccacaacccagctctgtgaatttcatagagaaccctccagatctcaatgattctaaccaggctcaggtggatgccaatgtagaccttgttagcccagacagcggactggctaccattaggagcagccgctcatccaaggagagctctgttttcctcagtgacgacagccccgtgggagaaggtgctgggcctcaccacacccttctcccagggcttgactcctacagccccatccctgaaggggcggtggcggaggaacatgcatggtctggagaacacggtgagcacttcgacctcttcaattttgacccagcacccatggcttctgggcagtcccagcaatcttctcattctgcagactactccccagcagatgacttcttccccaacagtgacctgtcagaaggacagctccccgctgggcctgaaggacttgatggcatgggaaccaacatgtctaattattcatccagttcacttttgtcaggggctggcaaagatagccttgtggaacatgatgaggagtttgtccagagacaagacagtcccagagataactctgaaagaaatttgagcctgacagattttgtgggagatgaatccccttccccagaaaggctaaaaaatactggaaagaggatcccaccaacacccatgaatagtttagtagaaagctcgccatccactgaagaaccagcctcactctatacagaagatatgacccaaaaagcaactgacacaggtcacatggggccacctcagacccatgcacggtgcagcagctggtggggtggtttggaaattgactccaaaaatattgcagatgcgtggagttccagtgaacaggaatctgttttccagagccctgaatcatggaaagagcataagccaagctccattgataggagagcctcagattctgtatttcaaccaaagagcctcgaatttacaaagtcaggtccctgggagtctgaatttggtcagcctgaactgggtagcaatgatattcaagacaaaaatgaggaaagcttgccgttccagaacctgcccatggagaagtcacctttgccaaatacatctccccaaggaacaaaccacctgatagaagactttgcttctttgtggcattctggtcgctctcccacagccatgcccgagccctggggaaatcctacagatgatggtgaaccagcagctgtggcgccattcccagcctggagtgcatttggtaaagaagatcatgatgaagctttaaaaaatacctggaatttgcacccaacaagcagcaagacaccttctgttagggacccgaatgagtgggccatggcaaaaagtgggtttgccttttcttcttcagaactactggacaattcacccagtgagataaacaatgaagcagctccagaaatctggggcaagaaaaacaatgactccagggatcacatctttgcacctggaaatcccagttctgatctggatcacacatggactaattctaagccaccaaaagaagatcagaatggtttagtggatcctaaaactaggggcaaggtatatgaaaaggtagattcctggaacctttttgaggagaatatgaagaaaggagggtcagatgtcctagttccttgggaagattccttcttatcttacaaatgttctgattacagtgcatccaacctaggagaagattcggtgccttcccccttagataccaattattccacctcagactcttacacatcaccaacatttgctggagacgaaaaggaaactgaacacaagccatttgctaaagaggaaggttttgagtcaaaagatggtaactccacggcagaggagactgacattcctcctcagtcactgcaacagtcatctcgaaatcgaatcagttcaggtcctgggaacctagacatgtgggcttcacctcatacagataacagttctgaaataaataccactcacaacctggatgaaaatgaactcaagacagagcacacagatggtaagaatatctccatggaggatgacgtcggggaaagcagccagtccagttacgacgaccccagcatgatgcaactgtacaatgaaacaaaccgacaactcacacttttgcacagcagcaccaactcccggcagacggcccctgacagtctcgacttgtggaacagagtgattttggaggatactcagtccactgcaacgatctcagatatggacaatgatttggactgggatgactgcagtgggggtgcggcaatccccagtgatggtcaaacagaaggatacatggctgaaggttccgagccggaaacccgatttacagtgagacagctggaaccctggggcttggagtatcaggaagcaaatcaggtagattgggagctccctgcctctgatgagcataccaaggacagtgctcccagtgaacatcacacattgaatgagaaaagtgggcagctaattgcaaacagtatttgggattctgtcatgagagataaagacatgtcatcattcatgttaccaggctcctcacatatcacagattcagagcaaagggaattgcctcctgaaatccccagccattcagcaaatgttaaagacactcattccccagatgcgccagcagcctctggaaccagtgaatcagaggcacttatatctcatcttgacaagcaggacacagagagggaaaccctgcaaagtgatgcagcatccttggcgactaggcttgagaatccagggtattttccacacccagatccatggaaaggtcatggcgatggacaaagtgaaagtgagaaggaagcccagggagccactgacagggggcaccttgatgaagaggaggtgatcgcctctggtgtggagaatgcctcagggatttctgaaaaagggcagagtgaccaggaactgtcttctctggttgcatctgaacatcaggaaatctgcattaaatcaggcaaaatcagctctcttgctgtcactttcagtcctcaaaccgaggaaccagaggaagttttagagtatgaggaggggtcttacaatctagactcccgtgatgtgcaaacagggatgtccgcagataacctgcagccaaaagatacccatgaaaaacacctcatgagtcaaagaaattcaggtgaaactactgagacttcagatgggatgaatttcacaaaatatgtatctgtacctgaaaaggatcttgagaaaactgaagaatgtaactttctagagccagagaacgtgggtggagggccacctcacagagttccccgaagtcttgattttggggacgtccctatagacagtgatgtgcatgtcagcagcacatgttctgagataaccaaaaatcttgacgttaaggggtctgaaaatagccttccaggagccggttcgtctggaaattttgacagagatactatttctagtgagtatactcattcaagtgcatcaagtcctgagttaaatgactcttcagttgcactgtcctcctggggccagcaacccagttctgggtatcaagaagaaaaccaaggcaactggagtgaacagaatcaccaagaatctgaactaattaccactgatggccaagtagaaatagttaccaaagtgaaggatttagagaaaaacagaataaatgagtttgaaaagagctttgatcgcaaaactcctacatttttagagatctggaatgactcagttgatggtgattccttttcctctttatccagtcctgaaacaggcaaatattctgaacattcagggacacatcaggaaagcaatctaattgctagctaccaggagaaaaatgaacatgacatttctgcaactgtgcagccagaggatgccagggtcatttcaacaagctcaggttctgatgatgacagtgtcggtggtgaagagtcaatagaggaagagatccaggtggccaactgccacgttgctgaggatgaatccagagcttgggattcattgaatgaatctaataagttcttggtcacagctgatcctaagtctgaaaatatttatgactacctagacagctcagagccagcagagaatgagaataagtcaaacccattctgtgacaatcaacaaagcagccctgatccctggactttctcaccattaacggagactgaaatgcagattacagcagtggagaaggagaagagatcttctccagaaacagggacaacaggagatgttgcatggcaaatatctcccaaagcttcgttcccaaagaacgaagataattctcaactggaaatgctgggcttctcagctgatagcactgagtggtggaaggcctcaccccaggaagggagactaattgaaagtccatttgaaagggagctgtctgactccagtggtgtgttggagataaattcttcagtacaccaaaatgccagtccctggggagtaccagttcagggtgatattgagcccgtggaaacacactatactaatccttttagtgacaaccatcagtcaccctttctggaaggtaatgggaagaactcccatgagcaactctggaacattcaaccaaggcagccagacccagatgctgacaagttcagccagcttgtaaaattagaccaaattaaagaaaaggactcaagagagcaaacctttgtgtctgctgctggtgatgagctgactcctgaaacacctacccaagagcagtgtcaggacaccatgctgccagtctgtgatcatccggacacagcctttactcacgcagaggaaaatagttgtgttacatctaatgtttcaactaatgaaggtcaagaaacaaatcagtgggaacaagaaaaatcatacctaggtgagatgacaaattcaagcattgccacagaaaattttcctgctgtcagttctcccacccaactgataatgaagccaggctctgaatgggatggctctaccccaagtgaggactcccgaggtacctttgtgccagatattttacatggcaactttcaagagggtgggcagctggcctctgccgcgcctgacttgtggatagatgctaagaagcccttcagtttgaaagcagatggtgagaatcctgatatcctgacgcactgcgaacatgacagcaattctcaggcttccgacagccctgatatatgtcacgattctgaagcaaagcaagagactgagaagcacctcagtgcttgcatgggacctgaagtggaatccagtgagctttgtctcactgagccagagatagatgaagaacccatttatgagcctggacgggagtttgtcccatccaatgcagaactcgattctgaaaacgcaactgtgctgcctccaattggctatcaagcagacataaagggctcctctcagcccgcctctcataaaggttcacctgaaccttctgaaataaacggtgacaacagtacaggtttacaagtatcagaaaaaggagccagcccagatatggcaccaattttggaaccagttgacagaagaatcccaaggattgaaaatgtggcaactagcatttttgtaactcaccaagagccaactccagaaggtgacggttcttggatatcagacagcttttctcctgaaagtcagcctggtgcaagagctttgtttgatggtgatccacatttatccacagagaatcctgccttggttcctgatgctttgctagcctcagacacttgtctggatataagcgaagctgcctttgaccacagtttcagcgatgcctcaggtctcaacacatccacgggaacaatagatgacatgagtaaactgacattatccgaaggccatccggaaacgccagttgatggggacctagggaagcaagatatctgctcatctgaagcctcgtggggtgattttgaatatgatgtaatgggccagaatatcgatgaagatttactgagagagcctgaacacttcctgtatggtggtgaccctcctttggaggaagattctctgaagcagtcgctggcaccgtacacacctccctttgatttgtcttatctcacagaacctgcccagagtgctgaaacaatagaggaagctgggtctccagaggatgaatctctgggatgcagagcagcagagatagtgctttctgcacttcctgatcgaagaagtgagggaaaccaggctgagaccaaaaacagactgcctggatcccagctggctgtgctgcatattcgtgaagaccctgagtccgtttatttgccggtaggagcaggctccaacattttgtctccatcaaacgttgactgggaagtagaaacagataattctgatttaccagcaggtggagacataggaccaccaaatggtgccagcaaggaaatatcagaattggaagaagaaaaaacaattcctaccaaagagcctgagcagataaaatcagaatacaaggaagaaagatgtacagagaagaatgaagatcgtcatgcactacacatggattacatacttgtaaaccgtgaagaaaattcacactcaaagccagagacctgtgaagaaagagaaagcatagctgaattagaattgtatgtaggttccaaagaaacagggctgcagggaactcagttagcaagcttcccagacacatgtcagccagcctccttaaatgaaagaaaaggtctctctgcagagaaaatgtcttctaaaagcgatacgagatcatcttttgaaagccctgcacaagaccagagttggatgttcttgggccatagtgaggttggtgatccatcactggatgccagggactcagggcctgggtggtctggcaagactgtggagccgttctctgaactcggcttgggtgagggtccccagctgcagattctggaagaaatgaagcctctagaatctttggcactagaggaagcctctggtccagtcagccaatcacagaagagtaagagccgaggcagggctggcccggatgcagttacgttgcaggctgtcacccatgacaatgaatgggaaatgctttcaccacagcctgttcagaaaaacatgatccctgacacggaaatggaggaggagacagagttccttgagctcggaaccaggatatcaagaccaaatggactactgtcagaggatgtaggaatggacatcccctttgaagagggcgtgctgagtcccagtgctgcagacatgaggcctgaacctcctaattctctggatcttaatgacactcatcctcggagaatcaagctcacagccccaaatatcaatctttctctggaccaaagtgaaggatctattctctctgatgataacttggacagtccagatgaaattgacatcaatgtggatgaacttgatacccccgatgaagcagattcttttgagtacactggccatgaagatcccacagccaacaaagattctggccaagagtcagagtctattccagaatatacggccgaagaggaacgggaggacaaccggctttggaggacagtggtcattggagaacaagagcagcgcattgacatgaaggtcatcgagccctacaggagagtcatttctcacggaggatactatggggacggtctaaatgccatcattgtgtttgccgcctgttttctgccagacagcagtcgggcggattaccactatgtcatggaaaatcttttcctatatgtaataagtactttagagttgatggtagctgaagactatatgattgtgtacttgaatggtgcaaccccaagaaggaggatgccagggctaggctggatgaagaaatgctaccagatgattgacagacggttgaggaagaatttgaaatcattcatcattgttcatccatcttggttcatcagaacaatccttgctgtgacacgaccttttataagttcaaaattcagcagtaaaattaaatatgtcaatagcttatcagaactcagtgggctgatcccaatggattgcatccacattccagagagcatcatcaaactggatgaagaactgagggaagcatcagaggcagctaaaactagctgcctttacaatgatccagaaatgtcttctatggagaaggatattgacttgaagctgaaagaaaagccttagttggccatgctggaagaagaggatgcttttctggttcatggttctgttgaaacatatctacctgaaagagacagggctgatgttacctttttccactttgcactacctggtgccattctaaatttctaaggggaaaaatagaaagtttgtttactcttaagatattttatgaaattgtgtgtactttcctattttgccaattatgtgcctcaaagattttagttgagccttagcaagaaagtaggaccttccatttcaatacttcattaacacggtgtagtgatactttgtcccttagactggtgtttaccagtaagatacctttaatccactgttaagtatgagtggatttgtttccatagattagctggatttccttttggtgattgcattaggtttaaagtacacaggtctcaactctccccaggaaagtttcccctgtttgactccacctttaaaatcctaagcctgactaggacagccacaaaccacacaaggtgtaaaaccatcatcagctaagtgcccgttttgttcttgtttaccagaatctcctttaacttctcaaagggaagccgggctttctaatccacgtcaactttattttagttgtcaaattgggcattatattttatgtaaattggtcttttaacatcattttcctgatgaatgttggtgaccaccacattgtgaaatttaagaatccgtgttgcatgtttggtagctctctgagtttcaggccataaactcagctccagaggttaccttttaagtgccaagaactcaagtgcaaggtggcctactcaaaaatcatttggtagcattcagttattcatgaattcctctctcgcatgcattataaaaagtgatctgctttaaaacaccgtaatctgatcataggcttaaaattaaatatgagtattactttcatgtacaaaatatttcctttatagtcttcatatgccctttaaaatgccaacaagatttcaagtctgtaggcctctagtgaggtggggtggcaaaccacagctaagtctcgctcaccactgcaagctaagaatggtttttacattttgggttggaaaaattttttttgaatatttcatgacacatgaaaattattcaaatgttagtgccgataaataaagtggtactgaaacacagccacacaaacttgtttttgtactgtctacagctactttcacactacagccgcagagctgagcagttcagcagaccgtatgtcccacaatgcctaaaacattgactatgtttacagaaaaagtttgctgacccctgctctagcaaacgcatcctttcctactccaccccaatttgtatttagatagtttctctaacagaacggacaaatgaggctgcaaactaatttatttttgtcaaaaatcaatgttttgacatccacagacagtgaaataaaagaaatggcttgctgaaaaacatgaggagtcctagccacaaaatcactgcttaggttgcaattgccaaaatgaagccttcttagaagcacttctttagtatatacaggtgttggctgaagtccgtgcctcactctgggaaccattcttagtctccagtgtctcctattacaaagaagctggcagaaataaaaatgaaggggtgagagcggttccaccctagtctcatggtggaaaattcattggggagagctgtccaggatatttggagtcctgggtagaaggagcttgtaactactttaaagtcgacatctttgcacaggtgattgagtttctctgacctcattgcttcacctctgtctcctcccgtccttccgcacgtgcccacacacacgcagttcagccctctttcctccataagcctccatcgttttctcttttctcctcttgatcctttcaagcgagtatcttgttgaattgtatgttctgttggatctcctccttcataacatctggcttgttggacagaaaaaccctacagcccaccccctcccacagcccacctccacttttgaaagcccaaattacacctctcccagaacacagtgttgacgtaaatacagttacccaatattcctgtttgttcacctatttgctactttcactcagtagcatcccattttgtaaaatgaattccatggtcaccctgtcacaggaagtaatgaaaaatccagtgttcagtgtagtggtgcaaacctgagggcatagagctgttcatagagggctcttgttatagccaaacagacacagcaacaatctcaccatttatatatatatttttaacttgtccagctcatctatggaaaactactcaggtggtatgctgtttgaagcctcatcttcctacatgaaaattatgggcatttgtcccaatgattttgtttcagctgttctgtaggctgcataaccactctgatatttaggtatctgctattttattatcttaaaagacaaattaatttaattgcatgtgctagggaaaagctaccatgtacattcaccccaagtaaatagaatcctagatgaatcctagaaaaataatccctaagcagataggtagacagaggtaaacattcacatgatttagctctctagctcttgcactctgaacattcttgctttggttctgacttctgggaactgctttgcatttctcctatagatctgtagttaagggaaccaaggggtcattggggcaaaagcattgtttctcaaagctccttgattaagagaaagaacagaaatttgcacagaagatagtgtcaaggagtgagaaagtttgtttgagggcagtagctcagtgtggaagaaaatcctgaagtttctgttgaagccatacaatgttctatggggttactctctaagacattctctgaggtgtgtgaggaagtcactactcctagcctttgttaagatgtaattttaaatattcagttatggtactatgtttgcaactctcgtcttatcacaatgcctcagtagtttgttcccttagaaacatttagatgtgcacaaattaatcttttatatatctaaaggtttttctatcatgcattggattgctcagaataaagtgtctgttagacttcgttttgg

SEQ ID NO: 172289 - DNA, 11512 bp, Homo sapiens
  Payload ID: 13873
  Gene Symbol: PEAK1
  Gene Name: pseudopodium-enriched atypical kinase 1
  Uniprot ID: Q9H792
  ENST ID: ENST00000312493
  CDS Start-End: 280-5520
tgcagtaaacattgctatcttcagaaattaaggaatgagaggcaaggaagaaaggacattcatcttggaaagacccaaagcaccttgaaatttggaaggaatgttttgctagctgctaaaaccacctttgtcaccagaatgaatgaagtgcttcagatttaaataattgatcattcttagaagagctgctgtaacacataggggaagtgaaaactaacagatgaaagttttgtcatgcactgaaagaaaagcattgtctgtgaagttctatttttaaaaatgtctgcttgtaacacctttactgaacatgtttggaaacctggtgaatgcaagaattgctttaaacctaaaagtttgcaccagcttcccccagaccctgagaaggcacccatcacccatggcaatgtgaaaactaatgccaatcacagtaacaaccaccgcatcaggaacacgggcaatttccggcctcctgtggctaaaaaacccactatagctgtgaagcccactatgatagtggcagatgggcaaagtatatgtggtgagcttagcatccaagaacactgtgagaacaaacctgtcatcatagggtggaaccgaaacagagctgccttgagtcagaaaccacttaacaataataatgaagatgatgaaggaattagccatgttcctaagccttatggcaataatgatagtgcaaagaagatgtcagataacaataatggactaactgaagtgttaaaggagatagcaggcttggatactgcccctcagataagaggaaatgaaacaaactccagagaaacattcttgggaagaataaatgattgctataaacgatcattggaaagaaagcttccaccaagttgcatgataggtgggataaaggaaactcagggcaagcatgttattctgagtgggagcacagaagtgattagtaatgaagggggccggttctgttacccagagttttccagtggcgaggagagtgaagaggatgtacttttcagtaacatggaggaggagcacgagagttgggatgagagtgatgaagagctgttggccatggagattcgcatgagagggcaacctcgctttgccaacttcagagcaaacacattgtctcctgttcgattctttgtggacaaaaaatggaataccatccccctgcgaaacaagtctctgcagagaatctgtgctgtggactatgatgacagctatgatgaaatcctgaatggttatgaggaaaattctgtggtctcttatggacaaggaagcattcagagcatggtgtcatctgactccacatcaccagattcttctttaacagaagaatcacgttctgagacagccagtagtttatcccagaagatttgtaatgggggattatctcctggtaacccaggagattctaaggacatgaaggaaattgagcccaattatgaaagtccctctagtaataatcaggataaagattcatcacaggcttccaaaagctcaataaaagttccagagacccacaaagcagtccttgctctccgattagaagagaaagatggcaagattgctgtacaaactgagaaggaagaaagtaaagcctctacagatgttgctgggcaagcagtaaccataaaccttgtccccacagaagagcaagcaaaaccttaccgagttgtgaacctggaacagccattgtgcaagccatatactgtcgtggatgtgtcagcagccatggccagtgagcacctcgagggccctgttaacagccccaagacaaaaagctcatcctctactccaaactctccagttacatcatcttcattgacaccaggacaaataagtgcccatttccaaaaatccagtgcaattcgataccaagaagtatggacttctagcaccagtccacgacaaaagatacctaaagtagaactaattactagtggaactggaccaaatgttcctccaaggaaaaactgtcacaaatcagcacctacatcacccacagctacaaacatttcctccaaaaccatccctgttaagtcacctaatttgtctgaaattaaatttaatagttataacaatgctggtatgccaccttttccaattatcattcatgacgagccaacttatgctcggagttccaaaaatgctatcaaagttcccattgttatcaatccaaatgcatatgacaatctagctatctacaaaagttttctgggaacaagtggagaactctcagtgaaggaaaaaaccacaagtgtaataagccatacttatgaagaaatagaaacagaaagcaaagtgcctgataacaccactagcaaaaccactgactgtcttcaaactaaagggttttcaaacagcacagagcataaaaggggctcagtggctcagaaggttcaagagtttaacaactgtctcaacagaggtcagtcttcaccacagagaagctatagttccagccacagctccccagcaaagatccagagagccactcaagagcctgtggccaaaatagaaggcactcaggagtctcagatggtgggcagcagcagcaccagagagaaagcaagcacagtgctttctcagattgtggcttcaatccaacccccacagtctcctccagaaacacctcaatctggccctaaagcttgcagtgtggaagagctttatgccattcctccagatgctgatgttgctaagagcacacctaagagtacgccagtccggcccaaatctctctttacatctcagcctagtggtgaggctgaagcacctcagaccacagacagtcctaccaccaaagtacagaaagacccatccataaagccagtcaccccctctccctccaaattagtgactagcccccaaagtgagccaccagctccctttcccccgccacgctctacttcttctccttaccatgcaggtaaccttttgcagaggcatttcaccaactggaccaagccaaccagccctaccaggtcaacagaagctgaatcagttttgcactctgaaggcagcaggcgggcagctgatgcaaaacctaagcgctggatatcatttaaaagcttcttccgccgtcggaaaacagatgaggaggatgacaaagagaaagagcgagagaaagggaaactggtgggcctggatggcacagtcattcacatgctgcctcctcctccagttcagcgccatcactggttcacagaggcgaaaggagagtccagtgagaaaccagccattgtcttcatgtacaggtgcgaccctgctcaaggccagctcagtgtggatcagagcaaggctaggacagaccaggcagcagtcatggagaagggtagagcagagaatgcattactacaggactcagagaagaagaggagtcattcttctccatcacagattcctaaaaagattctcagtcacatgacccatgaagtaacagaggatttttctcctcgggatccaagaactgttgttgggaagcaagatggcaggggctgcacttcagtcacaacagcattgtccctacctgaactggaaagggaagatggaaaagaagacatttcagatcctatggacccgaacccttgtagtgcaacatacagcaacttagggcaatctagagcagccatgatacctcccaagcagccacgacagcccaagggagctgtggacgatgccatcgcctttggagggaaaacagaccaagaagcacccaatgcttcccaacctacaccacccccactgccaaagaagatgatcataagagccaatacagagccaatctccaaggacctccaaaaatccatggaaagtagtctttgtgtcatggctaatcccacctatgatatcgaccccaactgggatgccagcagtgctggttcttccatcagctatgaactcaaaggactggacattgagtcttatgactccttggaaaggcctttgcgcaaggagagacctgtcccctcagcagcaaacagcatttccagcttaaccactctcagtattaaggatagattttccaacagcatggaatccctctccagccggcgtgggccctcttgcagacagggccgaggcatccagaagccgcagagacaagcactttatcgaggacttgagaatcgggaggaagtagtgggtaaaatccgaagccttcatacagatgccttgaagaaactggctgttaaatgcgaagaccttttcatggctgggcagaaagaccagctccgttttggagtggacagctggtcagacttcaggctaaccagtgacaaaccatgttgtgaggcaggtgatgcggtttactatactgcttcatatgcaaaagatccacttaataactatgcagtcaagatctgtaagagcaaagctaaagaatctcagcagtattatcacagcttggctgtccggcagagtctggctgtccattttaacattcagcaggactgtggtcatttccttgctgaagtccctaaccgtctgcttccctgggaggatccagatgaccctgaaaaggatgaggatgacatggaagagactgaagaagacgccaaaggagaaacggatgggaaaaacccaaagccctgttctgaagcagcatcatcccagaaagagaatcagggagtcatgagcaagaagcagaggagccacgttgtggtcatcaccagggaggttccatgtcttactgtggctgattttgtgcgagactctctggcccagcatgggaaaagccctgatttgtatgagaggcaggtgtgtctgctgctcttacagctatgctctggtcttgagcacctcaaaccctaccatgtcactcactgcgatctacgcctagagaacctgctacttgtccactaccagcctggggggactgcccaaggctttgggcctgcagagcccagccccacctcatcttatcccactaggcttatagtgagcaacttctctcaggccaagcagaagagccatctggtggaccccgagatcctccgggaccagtctcgccttgccccagagatcataacagctacccagtataaaaagtgtgatgagttccagacaggcatcctcatctatgagatgctgcacctacccaacccctttgatgagaacccagagctgaaggagagggaatacacacgagcagacctgcctcgcatcccattccgctccccctactcccggggtctgcagcagctggccagctgcctcctgaatcccaacccttctgagcggatcctcatttcagacgccaaaggcatcctccagtgtctgctctggggcccccgcgaagatctcttccagactttcaccgcctgccctagcctagtacagaggaacaccctgctccaaaactggctagacatcaagcgaacactgctcatgatcaagtttgctgagaagtccctggacagggaaggtggaatcagccttgaggactggctttgtgctcagtatttggcttttgccactacagactccctcagttgtattgtgaaaattctgcagcaccgttaatgtgtacctggatgatgcttttactacatcttcaccttcttcatgtcacccatgcacttcccctccctagtgctcactccaaattcaaggaaagaagaaaggcaaacctctatccctgtccgtgaacaagtgggtctattcagaaaggttatccactgccccagattgaatgagaagctgagtctgtcttaactttacagaaattcagctgcacaaacttgcagttgccttcccttgaaacaccttctatcctaatagtcccataaatgcaggtaaaaatgaaaatccatattcttgaagggacagcttctttggtatgaactcagccagtgagctgtgtccatttcctccataattctggatatcacctatctttttagcaccaagtatttattctcactagcagtagacagacttaaccagtctctaccacgacccagtagactctgacaacagactcttcctttaaggtgtcaacaactgacttactaggcaggactgccatccttagcatcagcccagttttggttaccagggactatatcttttgttccaggagagagtagaaagaaaaggagagatcccatccttgggtcatagacccattttcattgccattatctgtaagtatgtgcactgcatggaggacagccctaatagtctcccctctgctgccactgcctgattctccactctgtccccacttgccagtgaagtttggatttatcagccacttgtggcccattacagagctgacccaaggtggtgtcaccaatgcctcagcagggtggagtgcagttcagagcttataaatagctggcagggcatgaggagatgattttcttgcatgtgcaattctctaggggccatcaggaaacagagtttaaagtaccctttgattactgtcagaactgtcagcatttgcagttttccccgagcagtaattggccagctcccttctatcagtagccagtgttaactagtttaccaaatgctgtaaacaattgccctgaatgaaatagctgtcagtggagctctaagatctcctttagagggcacagtgaggtgggctgttgggatggccgtaggcaggggagaggaagaaggccactgatgagactgctgacctcctcagaaggttgacctcttctagagagactgcctcccagtgtttaagtggctcattgctccttctgactctgtaaaatggctctggaggacagctcacaggaattctgattgctgaggtgggtgattgagagctgttcaccatgtgtgcagcctgtgctccccttctatggatatgtgtgcaatttttgtatgtatttttttagctgtatattacagtgtttatgttgcaacttcacctgaagcgagtctacagaaaccctcccccttcttcccttggcacatatttgcgctaagagatgagcgttccttccactggggttgtgtgtgtgtgtgtgtgtgtgtgtgtgtgtgtgtgtgtgtgtgtatgtatacacatgttcacctgtgcttgttttattcaaaactgtgagtatgtgtttactttgaccttgaaatcccaagagtcactcgaacaatgtgtgtgtacacttgtgtgcccatgtgtgcgtgcacacgcatgctggaagtagaggccaggcctctagaaaagcaacctgtggcagggttgacagacatgttctctgtgcctagtgagtgagtgagccctgaggcccctcatctaccagtgcagagtttccttaaagccaagactgactgtgcagtattacttacatagcacattagtggccttggaaatttctaaacttttaacatttttaacagcttttcatgtgattcatgtataacaaagaggatcaggaaaggaaaataatgtattttattgtgctcttattacttttttaagtgattgtaatatgtgaggctctatttggagaatgtcccttatcccctggccagcaatataggactcacaggaaagaaggctggttagcccacaaagagtcttgcctcctctagccagagtgcagggctctgctcctaggaatggccatggagtgggcatgctgctgcaggccagcagtctgctcttggtgtcctgtggcatggccgcgccttgccttgaaggttggtgtttggttcatcttagcatagaacatgtgcacataactccttgcctgattatgcactgaagggcagcacacagaccactgaccatgtcagccagcacattcccttaacctcccccacctcccatcttgcaatgtcttgcatattgagatataccttctcaatgtcatgttcgtggtgccttgcccatgtaaatttcaatgttgactatttaatgaggttacatatttaatgctgaatgtttcctggtccctctatttgttatgtctctacttatctttttttttctttctctttttctgttatgatttggatccagtcttcactttaactctatggtataataagcatggacacctccactaccattatcttacagcactggtaaaccaagcacctcttcatatcagatgtttttagtactgtttttatattcagatttgttaagggcaaaagatgaatgcaaactagccagagaaaagcctcaggcttcccagagacaggtggctagattaatttttctctgggtgatggccaaagaatgtgagatagagagggaagggggtgttacaggttagagcagaatagagaaagaaactatatttctaggcaaaaagtactacatgagttggtcttcagaatatttttccaaaaaaatgaaattcagtcagtttaacattatcacaaatatttttcattttaattgtggtaggacctttgaatttgttcatcaactggaaagaaatcctaccctctgtagacacatacacacacatttatatatctatgtgtttgaattgtgactagtatagcactttacattttctcaagtaacaggaagttattgccttcaatattgattggaaattgttttctattgaagtctatactgtagagttttccatttatattgagagtttgaacaattaagctcctattggaacttttccttaagccacatgagcatgaacaatctctgtgacacttgggtgctagagaaacacaacagtggctaaagtagccaagagcaagactgaatgtatagcagagtgccttgttagagtggtaacctagtcttggaagcaattcagtggatgtttcataaagaggactagaacttcaagaagcctcctgtgctggctgaggtgagcccttttggtatatgtacactactgggttgcctagaagccaattcatgaagaataacagcaggatgagaaaaagagtcactgtaacctgtggaacaacaacgtaagaatcaccaacccctaggctgagctagaactggaagccaggaatatggcaatgagtttcaagatttgccctcagaagatgaactgggtgaggtatgggttgaggtgagggcacaagcactcatcctacctaccctgctgctgttgaggagctagaagtaaaacatattggttaggattttaacagttggagtagcctcccattatcagattaagtgggggtcacttttgcttccaaactcagaataagtttgtaaacatgggaaagtctaagccaagagatctaaagctctagaaatattaatgacatttctgggagtaaaactactaaaaattatatcttaaaagtttctagtagtatgaagttcccaggccaggcgcagtggctcacgcctgtaatcccaacactttaggagggcgaggtgggcagatcacctgaggtcaggagtttgagaccagcctggccaacatggtgaaactccatctctactaaaaatacaaaaattagccgggcatgatggcaggcacctgtaatctaagctactcgggaggctgaggcaagagaatctcttgaacccaggaggcaaaggttgcagtgagccaagatcacgccatcgcactccagcctgggagattgagcaacttcgtctcaaaaaaaagtttccaggaaagatctttgggtcctactaagcgtctcaattttgagttatgaatactttggttcagggaagtaacctgacatttggttttgctggaattagggttttcgctagatttgactgcaattaggatttcttctagattttaccagcagtgatctgaaaaagtacaggctagtcacagaaatagagatggatttaggatactacactatatttcaaatgattctagatgtgtaaatatagtatgaacattcttggagaggggtgagacaaactggacttgctgggccaaccctggcatgtttttcattctcctcactagttgacaaggattgaaaattccgctccagcctaatgagtgaacaggatggctgcccacaaaaccaagttattagctttatgtcatcgaagctcatattctcaaaggcccaaagtgctgtgccgagacaaatccaagtgctgctcttgctgaagtgcgcactgaagtccagctgtccgtgcttacagcagtgccaaaagtggggattccatggaccaaaaacggtgccataagggaagccagaagagttgcagtgcaagatcctgggagagattataccaaagaaatcaagcctttttatcctgatgcttctaagatgatgagggtgagctgtgacagatgctgtgggaggggagttcacatacattccatgtcaaggcatttagctgataaatccatcctcagaaaagcacctttttaaaaagaagtccattttgtatattagaagatgatgatgatgatgaagatgaagaaagccctggcagatacaaagttcctcagtatttaaggagaaggatctcttccatgtccccttgacatgactgtggctattgcccaaacctcagcttgagaacatcatataatactgagagcggaagatttttttaaagagatatggtagtttaaataggtttgtttaaagaactcttgggaaatttcttaacaaattgtaattgtttttataaaccttcctacagagttgtgtaccattcatcatcaccatcatttaatatctgtaagtgcccagaaggtacaaggtgctatacagccgttaaacaccccctccctgcaactgtttaaaattagaatagatttttgcatcaaccactgctagaagctttccccacctaggtgggctgcaagggcctgcattcccaacatcccattacatgtttcccactccagaaagtctctgggtttattccagctttttatcttgacgtgtcccattcacccccatggtttggtttggtttggttttgttttttaaatcaagaaagtttcagggaatcaaaagaggtcggacattttttaacctagcagaagtacagagtcatatattttgctacgaatattgttgtagtacagaaaacccactttgcccgttagtgtgtggatagtatgtgtgtgtccgcactcatgataacttgaatgttgaaccagacatagggttcatttttgaaaggttaaaccacactgtttcaggaacttgctccaaatactacttggttatcccttcctttaccagttagaactaaagagtgtgatgtatgaacacactgggttgggattttctgttgaggatatgcagggcattttggcatgaggcaaatacagaagcaagatttcattctacttggtgatttgaatcatgacagtcctcattccaatctctctttaattctctctggccctgcccacactctgtatttgaaaatcttgtttttgctctttccggagcttcacccctctacttacatattgtaaagttgtataaatctatcattgaaaggtcctctctgccagcagtggtgccaccctttggtttgctgtggtactttgctgtgtactccgtggcatcatgttactgtgtaaataaattcattttaatacacact

SEQ ID NO: 172290 - DNA, 19217 bp, Homo sapiens
  Payload ID: 13873
  Gene Symbol: PEAK1
  Gene Name: pseudopodium-enriched atypical kinase 1
  Uniprot ID: Q9H792
  ENST ID: ENST00000560626
  CDS Start-End: 477-5717
ggtggactcggccgcggcgagtagttagttagttgttgttagtcagtgtcagttgctcggcggcggcggccgtggtcaccaggaaggggacgggacggacggtgatggtggtcgccgcggcggcgtgtgcgcccctcaggtatctgcccaaactggaacttatgctgtagacatttctttgtggtttatctaaaaaccaaagtaaacattgctatcttcagaaattaaggaatgagaggcaaggaagaaaggacattcatcttggaaagacccaaagcaccttgaaatttggaaggaatgttttgctagctgctaaaaccacctttgtcaccagaatgaatgaagtgcttcagatttaaataattgatcattcttagaagagctgctgtaacacataggggaagtgaaaactaacagatgaaagttttgtcatgcactgaaagaaaagcattgtctgtgaagttctatttttaaaaatgtctgcttgtaacacctttactgaacatgtttggaaacctggtgaatgcaagaattgctttaaacctaaaagtttgcaccagcttcccccagaccctgagaaggcacccatcacccatggcaatgtgaaaactaatgccaatcacagtaacaaccaccgcatcaggaacacgggcaatttccggcctcctgtggctaaaaaacccactatagctgtgaagcccactatgatagtggcagatgggcaaagtatatgtggtgagcttagcatccaagaacactgtgagaacaaacctgtcatcatagggtggaaccgaaacagagctgccttgagtcagaaaccacttaacaataataatgaagatgatgaaggaattagccatgttcctaagccttatggcaataatgatagtgcaaagaagatgtcagataacaataatggactaactgaagtgttaaaggagatagcaggcttggatactgcccctcagataagaggaaatgaaacaaactccagagaaacattcttgggaagaataaatgattgctataaacgatcattggaaagaaagcttccaccaagttgcatgataggtgggataaaggaaactcagggcaagcatgttattctgagtgggagcacagaagtgattagtaatgaagggggccggttctgttacccagagttttccagtggcgaggagagtgaagaggatgtacttttcagtaacatggaggaggagcacgagagttgggatgagagtgatgaagagctgttggccatggagattcgcatgagagggcaacctcgctttgccaacttcagagcaaacacattgtctcctgttcgattctttgtggacaaaaaatggaataccatccccctgcgaaacaagtctctgcagagaatctgtgctgtggactatgatgacagctatgatgaaatcctgaatggttatgaggaaaattctgtggtctcttatggacaaggaagcattcagagcatggtgtcatctgactccacatcaccagattcttctttaacagaagaatcacgttctgagacagccagtagtttatcccagaagatttgtaatgggggattatctcctggtaacccaggagattctaaggacatgaaggaaattgagcccaattatgaaagtccctctagtaataatcaggataaagattcatcacaggcttccaaaagctcaataaaagttccagagacccacaaagcagtccttgctctccgattagaagagaaagatggcaagattgctgtacaaactgagaaggaagaaagtaaagcctctacagatgttgctgggcaagcagtaaccataaaccttgtccccacagaagagcaagcaaaaccttaccgagttgtgaacctggaacagccattgtgcaagccatatactgtcgtggatgtgtcagcagccatggccagtgagcacctcgagggccctgttaacagccccaagacaaaaagctcatcctctactccaaactctccagttacatcatcttcattgacaccaggacaaataagtgcccatttccaaaaatccagtgcaattcgataccaagaagtatggacttctagcaccagtccacgacaaaagatacctaaagtagaactaattactagtggaactggaccaaatgttcctccaaggaaaaactgtcacaaatcagcacctacatcacccacagctacaaacatttcctccaaaaccatccctgttaagtcacctaatttgtctgaaattaaatttaatagttataacaatgctggtatgccaccttttccaattatcattcatgacgagccaacttatgctcggagttccaaaaatgctatcaaagttcccattgttatcaatccaaatgcatatgacaatctagctatctacaaaagttttctgggaacaagtggagaactctcagtgaaggaaaaaaccacaagtgtaataagccatacttatgaagaaatagaaacagaaagcaaagtgcctgataacaccactagcaaaaccactgactgtcttcaaactaaagggttttcaaacagcacagagcataaaaggggctcagtggctcagaaggttcaagagtttaacaactgtctcaacagaggtcagtcttcaccacagagaagctatagttccagccacagctccccagcaaagatccagagagccactcaagagcctgtggccaaaatagaaggcactcaggagtctcagatggtgggcagcagcagcaccagagagaaagcaagcacagtgctttctcagattgtggcttcaatccaacccccacagtctcctccagaaacacctcaatctggccctaaagcttgcagtgtggaagagctttatgccattcctccagatgctgatgttgctaagagcacacctaagagtacgccagtccggcccaaatctctctttacatctcagcctagtggtgaggctgaagcacctcagaccacagacagtcctaccaccaaagtacagaaagacccatccataaagccagtcaccccctctccctccaaattagtgactagcccccaaagtgagccaccagctccctttcccccgccacgctctacttcttctccttaccatgcaggtaaccttttgcagaggcatttcaccaactggaccaagccaaccagccctaccaggtcaacagaagctgaatcagttttgcactctgaaggcagcaggcgggcagctgatgcaaaacctaagcgctggatatcatttaaaagcttcttccgccgtcggaaaacagatgaggaggatgacaaagagaaagagcgagagaaagggaaactggtgggcctggatggcacagtcattcacatgctgcctcctcctccagttcagcgccatcactggttcacagaggcgaaaggagagtccagtgagaaaccagccattgtcttcatgtacaggtgcgaccctgctcaaggccagctcagtgtggatcagagcaaggctaggacagaccaggcagcagtcatggagaagggtagagcagagaatgcattactacaggactcagagaagaagaggagtcattcttctccatcacagattcctaaaaagattctcagtcacatgacccatgaagtaacagaggatttttctcctcgggatccaagaactgttgttgggaagcaagatggcaggggctgcacttcagtcacaacagcattgtccctacctgaactggaaagggaagatggaaaagaagacatttcagatcctatggacccgaacccttgtagtgcaacatacagcaacttagggcaatctagagcagccatgatacctcccaagcagccacgacagcccaagggagctgtggacgatgccatcgcctttggagggaaaacagaccaagaagcacccaatgcttcccaacctacaccacccccactgccaaagaagatgatcataagagccaatacagagccaatctccaaggacctccaaaaatccatggaaagtagtctttgtgtcatggctaatcccacctatgatatcgaccccaactgggatgccagcagtgctggttcttccatcagctatgaactcaaaggactggacattgagtcttatgactccttggaaaggcctttgcgcaaggagagacctgtcccctcagcagcaaacagcatttccagcttaaccactctcagtattaaggatagattttccaacagcatggaatccctctccagccggcgtgggccctcttgcagacagggccgaggcatccagaagccgcagagacaagcactttatcgaggacttgagaatcgggaggaagtagtgggtaaaatccgaagccttcatacagatgccttgaagaaactggctgttaaatgcgaagaccttttcatggctgggcagaaagaccagctccgttttggagtggacagctggtcagacttcaggctaaccagtgacaaaccatgttgtgaggcaggtgatgcggtttactatactgcttcatatgcaaaagatccacttaataactatgcagtcaagatctgtaagagcaaagctaaagaatctcagcagtattatcacagcttggctgtccggcagagtctggctgtccattttaacattcagcaggactgtggtcatttccttgctgaagtccctaaccgtctgcttccctgggaggatccagatgaccctgaaaaggatgaggatgacatggaagagactgaagaagacgccaaaggagaaacggatgggaaaaacccaaagccctgttctgaagcagcatcatcccagaaagagaatcagggagtcatgagcaagaagcagaggagccacgttgtggtcatcaccagggaggttccatgtcttactgtggctgattttgtgcgagactctctggcccagcatgggaaaagccctgatttgtatgagaggcaggtgtgtctgctgctcttacagctatgctctggtcttgagcacctcaaaccctaccatgtcactcactgcgatctacgcctagagaacctgctacttgtccactaccagcctggggggactgcccaaggctttgggcctgcagagcccagccccacctcatcttatcccactaggcttatagtgagcaacttctctcaggccaagcagaagagccatctggtggaccccgagatcctccgggaccagtctcgccttgccccagagatcataacagctacccagtataaaaagtgtgatgagttccagacaggcatcctcatctatgagatgctgcacctacccaacccctttgatgagaacccagagctgaaggagagggaatacacacgagcagacctgcctcgcatcccattccgctccccctactcccggggtctgcagcagctggccagctgcctcctgaatcccaacccttctgagcggatcctcatttcagacgccaaaggcatcctccagtgtctgctctggggcccccgcgaagatctcttccagactttcaccgcctgccctagcctagtacagaggaacaccctgctccaaaactggctagacatcaagcgaacactgctcatgatcaagtttgctgagaagtccctggacagggaaggtggaatcagccttgaggactggctttgtgctcagtatttggcttttgccactacagactccctcagttgtattgtgaaaattctgcagcaccgttaatgtgtacctggatgatgcttttactacatcttcaccttcttcatgtcacccatgcacttcccctccctagtgctcactccaaattcaaggaaagaagaaaggcaaacctctatccctgtccgtgaacaagtgggtctattcagaaaggttatccactgccccagattgaatgagaagctgagtctgtcttaactttacagaaattcagctgcacaaacttgcagttgccttcccttgaaacaccttctatcctaatagtcccataaatgcaggtaaaaatgaaaatccatattcttgaagggacagcttctttggtatgaactcagccagtgagctgtgtccatttcctccataattctggatatcacctatctttttagcaccaagtatttattctcactagcagtagacagacttaaccagtctctaccacgacccagtagactctgacaacagactcttcctttaaggtgtcaacaactgacttactaggcaggactgccatccttagcatcagcccagttttggttaccagggactatatcttttgttccaggagagagtagaaagaaaaggagagatcccatccttgggtcatagacccattttcattgccattatctgtaagtatgtgcactgcatggaggacagccctaatagtctcccctctgctgccactgcctgattctccactctgtccccacttgccagtgaagtttggatttatcagccacttgtggcccattacagagctgacccaaggtggtgtcaccaatgcctcagcagggtggagtgcagttcagagcttataaatagctggcagggcatgaggagatgattttcttgcatgtgcaattctctaggggccatcaggaaacagagtttaaagtaccctttgattactgtcagaactgtcagcatttgcagttttccccgagcagtaattggccagctcccttctatcagtagccagtgttaactagtttaccaaatgctgtaaacaattgccctgaatgaaatagctgtcagtggagctctaagatctcctttagagggcacagtgaggtgggctgttgggatggccgtaggcaggggagaggaagaaggccactgatgagactgctgacctcctcagaaggttgacctcttctagagagactgcctcccagtgtttaagtggctcattgctccttctgactctgtaaaatggctctggaggacagctcacaggaattctgattgctgaggtgggtgattgagagctgttcaccatgtgtgcagcctgtgctccccttctatggatatgtgtgcaatttttgtatgtatttttttagctgtatattacagtgtttatgttgcaacttcacctgaagcgagtctacagaaaccctcccccttcttcccttggcacatatttgcgctaagagatgagcgttccttccactggggttgtgtgtgtgtgtgtgtgtgtgtgtgtgtgtgtgtgtgtgtgtgtatgtatacacatgttcacctgtgcttgttttattcaaaactgtgagtatgtgtttactttgaccttgaaatcccaagagtcactcgaacaatgtgtgtgtacacttgtgtgcccatgtgtgcgtgcacacgcatgctggaagtagaggccaggcctctagaaaagcaacctgtggcagggttgacagacatgttctctgtgcctagtgagtgagtgagccctgaggcccctcatctaccagtgcagagtttccttaaagccaagactgactgtgcagtattacttacatagcacattagtggccttggaaatttctaaacttttaacatttttaacagcttttcatgtgattcatgtataacaaagaggatcaggaaaggaaaataatgtattttattgtgctcttattacttttttaagtgattgtaatatgtgaggctctatttggagaatgtcccttatcccctggccagcaatataggactcacaggaaagaaggctggttagcccacaaagagtcttgcctcctctagccagagtgcagggctctgctcctaggaatggccatggagtgggcatgctgctgcaggccagcagtctgctcttggtgtcctgtggcatggccgcgccttgccttgaaggttggtgtttggttcatcttagcatagaacatgtgcacataactccttgcctgattatgcactgaagggcagcacacagaccactgaccatgtcagccagcacattcccttaacctcccccacctcccatcttgcaatgtcttgcatattgagatataccttctcaatgtcatgttcgtggtgccttgcccatgtaaatttcaatgttgactatttaatgaggttacatatttaatgctgaatgtttcctggtccctctatttgttatgtctctacttatctttttttttctttctctttttctgttatgatttggatccagtcttcactttaactctatggtataataagcatggacacctccactaccattatcttacagcactggtaaaccaagcacctcttcatatcagatgtttttagtactgtttttatattcagatttgttaagggcaaaagatgaatgcaaactagccagagaaaagcctcaggcttcccagagacaggtggctagattaatttttctctgggtgatggccaaagaatgtgagatagagagggaagggggtgttacaggttagagcagaatagagaaagaaactatatttctaggcaaaaagtactacatgagttggtcttcagaatatttttccaaaaaaatgaaattcagtcagtttaacattatcacaaatatttttcattttaattgtggtaggacctttgaatttgttcatcaactggaaagaaatcctaccctctgtagacacatacacacacatttatatatctatgtgtttgaattgtgactagtatagcactttacattttctcaagtaacaggaagttattgccttcaatattgattggaaattgttttctattgaagtctatactgtagagttttccatttatattgagagtttgaacaattaagctcctattggaacttttccttaagccacatgagcatgaacaatctctgtgacacttgggtgctagagaaacacaacagtggctaaagtagccaagagcaagactgaatgtatagcagagtgccttgttagagtggtaacctagtcttggaagcaattcagtggatgtttcataaagaggactagaacttcaagaagcctcctgtgctggctgaggtgagcccttttggtatatgtacactactgggttgcctagaagccaattcatgaagaataacagcaggatgagaaaaagagtcactgtaacctgtggaacaacaacgtaagaatcaccaacccctaggctgagctagaactggaagccaggaatatggcaatgagtttcaagatttgccctcagaagatgaactgggtgaggtatgggttgaggtgagggcacaagcactcatcctacctaccctgctgctgttgaggagctagaagtaaaacatattggttaggattttaacagttggagtagcctcccattatcagattaagtgggggtcacttttgcttccaaactcagaataagtttgtaaacatgggaaagtctaagccaagagatctaaagctctagaaatattaatgacatttctgggagtaaaactactaaaaattatatcttaaaagtttctagtagtatgaagttcccaggccaggcgcagtggctcacgcctgtaatcccaacactttaggagggcgaggtgggcagatcacctgaggtcaggagtttgagaccagcctggccaacatggtgaaactccatctctactaaaaatacaaaaattagccgggcatgatggcaggcacctgtaatctaagctactcgggaggctgaggcaagagaatctcttgaacccaggaggcaaaggttgcagtgagccaagatcacgccatcgcactccagcctgggagattgagcaacttcgtctcaaaaaaaagtttccaggaaagatctttgggtcctactaagcgtctcaattttgagttatgaatactttggttcagggaagtaacctgacatttggttttgctggaattagggttttcgctagatttgactgcaattaggatttcttctagattttaccagcagtgatctgaaaaagtacaggctagtcacagaaatagagatggatttaggatactacactatatttcaaatgattctagatgtgtaaatatagtatgaacattcttggagaggggtgagacaaactggacttgctgggccaaccctggcatgtttttcattctcctcactagttgacaaggattgaaaattccgctccagcctaatgagtgaacaggatggctgcccacaaaaccaagttattagctttatgtcatcgaagctcatattctcaaaggcccaaagtgctgtgccgagacaaatccaagtgctgctcttgctgaagtgcgcactgaagtccagctgtccgtgcttacagcagtgccaaaagtggggattccatggaccaaaaacggtgccataagggaagccagaagagttgcagtgcaagatcctgggagagattataccaaagaaatcaagcctttttatcctgatgcttctaagatgatgagggtgagctgtgacagatgctgtgggaggggagttcacatacattccatgtcaaggcatttagctgataaatccatcctcagaaaagcacctttttaaaaagaagtccattttgtatattagaagatgatgatgatgatgaagatgaagaaagccctggcagatacaaagttcctcagtatttaaggagaaggatctcttccatgtccccttgacatgactgtggctattgcccaaacctcagcttgagaacatcatataatactgagagcggaagatttttttaaagagatatggtagtttaaataggtttgtttaaagaactcttgggaaatttcttaacaaattgtaattgtttttataaaccttcctacagagttgtgtaccattcatcatcaccatcatttaatatctgtaagtgcccagaaggtacaaggtgctatacagccgttaaacaccccctccctgcaactgtttaaaattagaatagatttttgcatcaaccactgctagaagctttccccacctaggtgggctgcaagggcctgcattcccaacatcccattacatgtttcccactccagaaagtctctgggtttattccagctttttatcttgacgtgtcccattcacccccatggtttggtttggtttggttttgttttttaaatcaagaaagtttcagggaatcaaaagaggtcggacattttttaacctagcagaagtacagagtcatatattttgctacgaatattgttgtagtacagaaaacccactttgcccgttagtgtgtggatagtatgtgtgtgtccgcactcatgataacttgaatgttgaaccagacatagggttcatttttgaaaggttaaaccacactgtttcaggaacttgctccaaatactacttggttatcccttcctttaccagttagaactaaagagtgtgatgtatgaacacactgggttgggattttctgttgaggatatgcagggcattttggcatgaggcaaatacagaagcaagatttcattctacttggtgatttgaatcatgacagtcctcattccaatctctctttaattctctctggccctgcccacactctgtatttgaaaatcttgtttttgctctttccggagcttcacccctctacttacatattgtaaagttgtataaatctatcattgaaaggtcctctctgccagcagtggtgccaccctttggtttgctgtggtactttgctgtgtactccgtggcatcatgttactgtgtaaataaattcattttaatacacactaaaaaacagacaaatgcttgtccttttggcgactcttccacactgacatgctggggagggtttggttgcagacatggttatgtcttgtccccccagggtaggtgccctgtccataacacaggaaatgatggctttcagcctgtgtgtcttctgcactctgggtcctcatcccctgctgacatggattatatttctctttattccctgtctaatctgaggaaatcaggccccaaagagaaagcaaaggcattctgcttttcccagacctcagaaggctgcaggtttgctgtgtgagatcgccctctggtgagcagtcacctgcaggcttcctgggtttgtactgcatgttgagaggcttggttagctggctctggctgaccctctccgtggaaatcagagctattcaggtaatatgagcggggacagggcctggtactgcatcatctgcaagattcgcatgcctttgacacagtgatacacaggggcctcacaaaggcagacaagctaatgtgtggacacttcagcagcgcagaggaggcctcctggcttaagcaggaagagtcagcagtggtagcaacaactgccgcattatgagaggagaatagatgaaaaggcaaacatgtagatcctaaatttagagcagattttagagcaccaaaccctttacagtggacactgtctccaacccggtgtctctgctcttctccactagcaagcactctggaatttgcagatgctgtttttaaggcataccccagaagagtggctgccagacttgaggtttatgttgctgaggagcaacataacagaacccatgttggtgtggacccaaaagctctctgtgtgttgcctgggcccaggaggaagggtcaacagcaagcctgaccagacaatccccagggacacaggccctgcctgctgcagctgtgtagcctgcttgctggagaagagcctagagaacttcccttctagttgtcagcacaacacactggcttctgggggaaaggaagcaaagaaaaaagtaggcagttggggttgggaggtcacagaaacagagcgtaccaggaccgggctgctgtgtgaagctctgctggcctgagtggtcaccgtgtgtgccaggccaggtctcactaatgcaggactccataacaactgattcagtactgactgagtgattaaattaaatattaaaagctgaaggggccactgcccttatacgaaggctgaagtgtaacaaaagctccactgggagttttgcctagacctttcctgggccttgaagcatgacaaaatagcgaaggaattcttaacaggacctgtttaggattaaacaagtttatcgggggtctgaaggaactccccatacctccatgatttagcaggagacaagattaagggtaatcaccccagcacttggacccatttagattaagtaaacttactgaggctccagaggaaggtcttcaagactcagaccttagttatagattgaaagaagttggccggatgtggtggctcacacctgtaatcccagcactttgggaggccgaggtgggcggatcacgaggtcaggagatcgagaccatcctggctaacacggtgaaaccctgtctctactaaaaacacaaaaaagttagccgggcttggtggtgggcacctgtagtcccagctactcaggagggtggggcaggagaatggcgtgaacccaggaggtggagtttgcagtgagccgagattgctccactgcactgcagcctgggtgacagaacaagactccatctcaaaataaataaataaataaatagtcacttatgtctttagatgaatgcacacttacacgtagacatatagcttagaaggtatataagatgtgggaaaccgtaattttgagttgatctggcaataacttcgaggccttctccctgtaactggttacagaaataaaaactcccttctctcccggttcatctgcatctcgttactgggccgcaaaaataagcagcctgacccccagtttggtccagaaacacctggagccctgaaaggatacaggccagtggatggtgggaccagttcaggattgcccaagccagactccaggtgaggtggaacaaggccagaaaaaacactaagtttctattcttcagtgggatcactttgtcctttggtgtaactggagagcctggagataaattatcctattccccttccccatcacatcacccagcgtgggattcattcctgagaattccattagtggtcctcagtgatgccatcctgtctgactctgggttgtccggaggtgatgggccactgacagttggatggggcctttggcagctccatgcctgcagagtgttgtctttcaacctaagccacagagaatcttgatttctttcctgcccggagtgaattggtgtggggagctctccattgcctggggttgtaagtgtgtaccttctgctccaggaactctttgcctcctctccaaggcctagcaaattatgcttccttataagtgagttcgcactctcttctacaagggaaagaacttcattagtgccataggagccaagaactgcagttggcagatcacaagttgttgttaagagcagctcaaggcaattacagctgaaacttaaaaactggatttcacactgggtgggggggtaggagggaatttgttgccaagatccagttctctcaaatttgcaaacctctaaaaggaaataggctttttggacacaaactgacttccttgagatcccagataaacctctgtacaggtatgtgcgcgcacgcgcgcacacacacacacacacacacacacacacacacacacacaccaactaatggctcccttgccctctgggagctgcatggaagcaaccagaaagctgagtgataatgctgtgagggcttctgaggaatctgcaattataaggaccagggtcctctagagaagtaactctcatgcaggaagtggggggtatagggacttgggttttccccaccaggaccacccaatgctcaccagcccacacttgagctggagtcaaagatagagcaaaaaactccaagcctatggttcatctttgcccagggttgggggatgggaggcaaattgtacctcaggtaaagagaatgtggagggataaagtcaccaggccccccagggaggggcaaagttgaatgccttgaagagctgagatgctcctcttccagggtgaaggagtctgtctctagaaagccagccctgggggtgctttcccatgaactagcttaacagcttaattttatcttcacaatctggtgaggtggtttctagaattatccccattttacccttgtgaaaacaagtcagagagggtttgtttgccccagatccttagtaagggaactacgatttgtcatccagcaaccgtactccacctcccagcttcctggagtgagggacagtcctccctcactctctagctgtcaccccagtatcatcagtggcttcttggtgtccaaagaagaaaaatccaattgctgagtctgtgtcctccacctctcatgcttattgctgaccagatgttgcagcagctccactctccaggctggcctgggagacatgcattgaaattctctgcacccgcatcgttcctgttctttttctctctgttcttcagggccccattcagccaagaagcttttgggatgatagccatctgaaatcaccaactcactccccagcttcagctcctggcctggtgtgtgtgtgtgtctgtgtgtgtgcacctcccttctcgtgagctcctccagggaggccatggctttagctgctctgcctgctgtccttggtgtctgactcaactaacaggaagagaggaggaagagaaccacccctggctgctccactgggccaggccctggtccaggctttcccacacattaacctcatttgctctccactacagccattttacagatgaggaaactcagagtgggtaagaaacttgcctaaagctgcatagctggtaagtggtagagctgagattcaaacctaggcttgaagccagttctccccaccaccatacgagtctttgtctattggcttgtttttgtgccagcggataggcccaggcctatgggtgtttgctccaattgtgacagactggggtagccaaggagtgcttcctgatgtgggcagagagtgtgagtgagaagaaagcgctggctaggctgagcagtcagatctgtagcttccctgtagggccagcacctttccctgtcagaccttcactgaactcctatgggatcgccaggccaacacaaggcattagcactggccgtctttgagacatttcctctcaaggcccctgagcagacttgcctgtttgctctccatcttccctacagaggggcctcccaggactgcttctggaaccacaaaggcaactaagtggccaacagctgccacagagcaactgacaaccttcttttcctttttgtctttttctttctttttggttaataatctgctttccattcacctaccccctccactcccaccctgtcatggtaaatcagggttgtaaagtcctcaacccctaagagctccatgcttgagcaaatatatacaagacatacgcatatagctgtagggttccactctcttacaaaaattagatcttattgtgtacaatactctgcaaattgcttttcttacttaacaatatatatcattggccaggtgtggtggctcacgcatataatcccagcactttgggaggatcacttgagctcaaaagttagaccagcctgggcaacatgttgaaactccatctctacaaaaaaatacaaaaattagccaggtgtggtagcatacacctgtggtcccagctattcaggaagctgaggagggaggatcactcgagcccaggaggtcgaggccacagtgagccgtgaactgcactccagcctggggaacaaagtgagatcctgtctcaaaacaaaaacaaaaacaaaagcaaaaaaatcatggacaaagtatttcttaaaaggtagcttctcgcactaaaaataatagcattacataacatacatatatacaaattttattattattatttccacttcttcaggcgttcagtcacatagggatgactaaacaacaaaatatgagaaactactgagaagtataaaagatgcacagatacagagatgaactatcaggttgtctcaaattttagtgaaatttgaattttaaatctcaatgggttttttttctggagtgaaaaactttacaaaatggttttcagagtcagttggaggaacgaatacatgaaaaacccagaaatttttgaaattgaaggcataattgagcatatgaaaaagctatgatcaataaaacagtgtgatacaggtacaagaaaaaacagatcaatgtaatagaataggtaacctaaaaatagtatcagtatgaaactagtatatgtaatataggataagtaagacatcactatatgagaagggaaggaagtttatccaatgtgctggtacaattggttagctatttggaaaatattaatcttcatactataagctaatacaaatccaaacagatcaaacagagttacatgccacaaaggaaagaaaaatctcaagaactagaagaatgccaagtcaatgcatgttttatctcttgttgagaaaggactttgtaagctaagagacggtggaaggtgtctgaaagggaaagatcaataggtttgactaaaggtgataaacctttgtccatggaaaacagcagaaacaaaattgaaaagtaaataacccagaaaaaagatttcaacacatataacagacataggattaaaattctgagttataaagagctgatacaaatcattaggaacataaaacactaatagatgagaacagagaagtcacagaagaacccaaatgtttaagctttctagaaacaagagaaataacctaaggtggcatatctaaaaaaaaattttaacagctttttctgattgattataaaaataatgcctgtttacagtagaaaatgtggaaggtaaaattgacccactaggtcaccatctagaaatgaccaccattaacatttactgtatatcctgcaactgttgtttactctgcctttttctttttaaattaagatcatattgttggcatctcattttccacctatcaaattaacaaagctttttttttaaagcttatactccatgctggtgacagggtatacagttcagtcaatgttggtgcaattgaattggatggaaaggggcttgattcatcctgtcctggggtgttgggcaagggctgaccccagtagtcagcatggtggtgggtaatagagatttcagatctccaaggtcaaagtgacagagtcaccaggggagcttttcaaaaggaaagaccacccaagtccagtgactccaagaccccctcctccccagggtccttcagctattctgagcttgtaaggggcctctctgcctgaatctggatttagctccaggttccacctctgacaaactgtgtcctcagccattctctgagccttggttttgatggggattcctacctcacagggtcattgtcaggatgaaaggacacagtctagcaagtgtatttagtccactgccaggcaatagtaagtgctcaaatattgttgatcaaaaaggcaaactctgagtgggtatttactttctgtttttataaccaaggactcatcgggggatttttgctgaacaaagatactgtgaattcaaatctcggcctcgtaagaatcagaaaactgcttgcagcttttgagtggcaatttctccagctttccaaatatctcctggctgaatttcagaaagcctggttaacagtcgtttctctgaacacctcctacctgccgatggtgacatagcacatcagaggcagaaatgggtccatgcctctgaatccaagcctgccttcctccctacacaacctggaccctttattgggggagagtcaggcacagtggtaaactgacaagggacagggctgcgatgggaagtggggggtgaggatgaaagcagctgttgagggcccctctagctctgggccggtgtgctctttagagggtgtctgtgtcccgaagcaccccctccctccctcagcaaggggctggcccaggccctcacccttcctcggagcctgctgcccacatcagagccctcatttcagctcccctcatgacactgccttgcataataaatgcttcagttgaatgtactttattttggggaaagtcattaaactccttttgtggaaacattttaattgaattagattgttttctgattgtaatagatgttaattaattgagtgggccgagtgtccttggatgtagctggcttctctcagtttaattaggaggtgaatgtggacttatttctttttgctatgagtctgtggtttaaatttatcttttcagctaataaagtgatcaggcg

SEQ ID NO: 172291 - DNA, 4644 bp, Homo sapiens
  Payload ID: 13873
  Gene Symbol: PEAK1
  Gene Name: pseudopodium-enriched atypical kinase 1
  ENST ID: ENST00000558305
  CDS Start-End: 537-3686
agttagttagttgttgttagtcagtgtcagttgctcggcggcggcggccgtggtcaccaggaaggggacgggacggacggtgatggtggtcgccgcggcggcgtgtgcgcccctcaggtatctgcccaaactggaacttatgctgtagacatttctttgtggtttatctaaaaaccaaaggaaaagaatacttgagatccatttgtaaggaaagaaaaggaagcaacaacataatgcccagagttggagccaattaaaccagtaaacattgctatcttcagaaattaaggaatgagaggcaaggaagaaaggacattcatcttggaaagacccaaagcaccttgaaatttggaaggaatgttttgctagctgctaaaaccacctttgtcaccagaatgaatgaagtgcttcagatttaaataattgatcattcttagaagagctgctgtaacacataggggaagtgaaaactaacagatgaaagttttgtcatgcactgaaagaaaagcattgtctgtgaagttctatttttaaaaatgtctgcttgtaacacctttactgaacatgtttggaaacctggtgaatgcaagaattgctttaaacctaaaagtttgcaccagcttcccccagaccctgagaaggcacccatcacccatggcaatgtgaaaactaatgccaatcacagtaacaaccaccgcatcaggaacacgggcaatttccggcctcctgtggctaaaaaacccactatagctgtgaagcccactatgatagtggcagatgggcaaagtatatgtggtgagcttagcatccaagaacactgtgagaacaaacctgtcatcatagggtggaaccgaaacagagctgccttgagtcagaaaccacttaacaataataatgaagatgatgaaggaattagccatgttcctaagccttatggcaataatgatagtgcaaagaagatgtcagataacaataatggactaactgaagtgttaaaggagatagcaggcttggatactgcccctcagataagaggaaatgaaacaaactccagagaaacattcttgggaagaataaatgattgctataaacgatcattggaaagaaagcttccaccaagttgcatgataggtgggataaaggaaactcagggcaagcatgttattctgagtgggagcacagaagtgattagtaatgaagggggccggttctgttacccagagttttccagtggcgaggagagtgaagaggatgtacttttcagtaacatggaggaggagcacgagagttgggatgagagtgatgaagagctgttggccatggagattcgcatgagagggcaacctcgctttgccaacttcagagcaaacacattgtctcctgttcgattctttgtggacaaaaaatggaataccatccccctgcgaaacaagtctctgcagagaatctgtgctgtggactatgatgacagctatgatgaaatcctgaatggttatgaggaaaattctgtggtctcttatggacaaggaagcattcagagcatggtgtcatctgactccacatcaccagattcttctttaacagaagaatcacgttctgagacagccagtagtttatcccagaagatttgtaatgggggattatctcctggtaacccaggagattctaaggacatgaaggaaattgagcccaattatgaaagtccctctagtaataatcaggataaagattcatcacaggcttccaaaagctcaataaaagttccagagacccacaaagcagtccttgctctccgattagaagagaaagatggcaagattgctgtacaaactgagaaggaagaaagtaaagcctctacagatgttgctgggcaagcagtaaccataaaccttgtccccacagaagagcaagcaaaaccttaccgagttgtgaacctggaacagccattgtgcaagccatatactgtcgtggatgtgtcagcagccatggccagtgagcacctcgagggccctgttaacagccccaagacaaaaagctcatcctctactccaaactctccagttacatcatcttcattgacaccaggacaaataagtgcccatttccaaaaatccagtgcaattcgataccaagaagtatggacttctagcaccagtccacgacaaaagatacctaaagtagaactaattactagtggaactggaccaaatgttcctccaaggaaaaactgtcacaaatcagcacctacatcacccacagctacaaacatttcctccaaaaccatccctgttaagtcacctaatttgtctgaaattaaatttaatagttataacaatgctggtatgccaccttttccaattatcattcatgacgagccaacttatgctcggagttccaaaaatgctatcaaagttcccattgttatcaatccaaatgcatatgacaatctagctatctacaaaagttttctgggaacaagtggagaactctcagtgaaggaaaaaaccacaagtgtaataagccatacttatgaagaaatagaaacagaaagcaaagtgcctgataacaccactagcaaaaccactgactgtcttcaaactaaagggttttcaaacagcacagagcataaaaggggctcagtggctcagaaggttcaagagtttaacaactgtctcaacagaggtcagtcttcaccacagagaagctatagttccagccacagctccccagcaaagatccagagagccactcaagagcctgtggccaaaatagaaggcactcaggagtctcagatggtgggcagcagcagcaccagagagaaagcaagcacagtgctttctcagattgtggcttcaatccaacccccacagtctcctccagaaacacctcaatctggccctaaagcttgcagtgtggaagagctttatgccattcctccagatgctgatgttgctaagagcacacctaagagtacgccagtccggcccaaatctctctttacatctcagcctagtggtgaggctgaagcacctcagaccacagacagtcctaccaccaaagtacagaaagacccatccataaagccagtcaccccctctccctccaaattagtgactagcccccaaagtgagccaccagctccctttcccccgccacgctctacttcttctccttaccatgcaggtaaccttttgcagaggcatttcaccaactggaccaagccaaccagccctaccaggtcaacagaagctgaatcagttttgcactctgaaggcagcaggcgggcagctgatgcaaaacctaagcgctggatatcatttaaaagcttcttccgccgtcggaaaacagatgaggaggatgacaaagagaaagagcgagagaaagggaaactggtgggcctggatggcacagtcattcacatgctgcctcctcctccagttcagcgccatcactggttcacagaggcgaaaggagagtccagtgagaaaccagccattgtcttcatgtacaggtgcgaccctgctcaaggccagctcagtgtggatcagagcaaggctaggacagaccaggcagcagtcatggagaagggtagagcagagaatgcattactacaggactcagagaagaagaggagtcattcttctccatcacagattcctaaaaagattctcaggtatgtaaaatagactggaagaatatgggaattttttaacacattttcaggtgctaagttttttatatcttttaagattgcataagaaccatttctgtttgtaagtagcactctgtggccatcatctatctttataactgcattccaagattagaatagtattaaagtgatcttactgcactgaacaaggtttatagccctggatctttggcttaagtagcctactgcattctggtgaatgcagaggaactttagcatagaaaagcaaatccataacaccttaatagcaataaataatgtgttgttttggaatgtgatggtagtgtgaggaagaaacaggatcaaatgaataaatggtggtactgttctttccctcactgtaaatgaaataaagctcttccagcaattctttttgttttttatgaaggtgttatctctatatgcattacttattttaagggaatatttgtttttttattgctgtctctttctgtcctccttccaagtgttgtggaaaaaaatggagggtggtaagcaagcaatttatagttatttagcatgtgggtgaaataggagaagttgagtattgagactgagacccagtagtataatattcagttcagctagacagattgcatacccaaatcagttctctaggcattcattttcttgaataccttaataactatttattgatcacctattctgtgcaaggtatataataaatatttatctcaaatccttataaatttgctatattcttcagatgaggaaactgaaaacccgggaagttaagaattgaacagagtcacaaagctagtgcttttcagagctggaattcaaacctcgatctctcattctaaagcatgtatcctccttataattttgcattcttaaacacaagatcaataaaaattgttatattctcacttgtaatcattcacataaatacatatgtttaggaagcctaa

SEQ ID NO: 172292 - DNA, 558 bp, Homo sapiens
  Payload ID: 13873
  Gene Symbol: PEAK1
  Gene Name: pseudopodium-enriched atypical kinase 1
  ENST ID: ENST00000565820
  CDS Start-End: 379-558
atagttgcatatggccgcatattttgggaatatttttcttgtttgcatgtcttcatgatgttttcccaaaacgttgtaacattgtcaagaaataaaacagaaagtaaacattgctatcttcagaaattaaggaatgagaggcaaggaagaaaggacattcatcttggaaagacccaaagcaccttgaaatttggaaggaatgttttgctagctgctaaaaccacctttgtcaccagaatgaatgaagtgcttcagatttaaataattgatcattcttagaagagctgctgtaacacataggggaagtgaaaactaacagatgaaagttttgtcatgcactgaaagaaaagcattgtctgtgaagttctatttttaaaaatgtctgcttgtaacacctttactgaacatgtttggaaacctggtgaatgcaagaattgctttaaacctaaaagtttgcaccagcttcccccagaccctgagaaggcacccatcacccatggcaatgtgaaaactaatgccaatcacagtaacaaccaccgcatcaggaacacgggcaat

SEQ ID NO: 172293 - DNA, 2323 bp, Homo sapiens
  Payload ID: 13873
  Gene Symbol: PEAK1
  Gene Name: pseudopodium-enriched atypical kinase 1
  ENST ID: ENST00000564328
  CDS Start-End: 355-2323
agtgtcagttgctcggcggcggcggccgtggtcaccaggaaggggacgggacggacggtgatggtggtcgccgcggcggcgtgtgcgcccctcaggtatctgcccaaactggaacttatgctgtagacatttctttgtggtttatctaaaaaccaaaggaaaagaatacttgagatccatttgtaaggaaagaaaaggaagcaacaacataatgcccagagttggagccaattaaaccagattgatcattcttagaagagctgctgtaacacataggggaagtgaaaactaacagatgaaagttttgtcatgcactgaaagaaaagcattgtctgtgaagttctatttttaaaaatgtctgcttgtaacacctttactgaacatgtttggaaacctggtgaatgcaagaattgctttaaacctaaaagtttgcaccagcttcccccagaccctgagaaggcacccatcacccatggcaatgtgaaaactaatgccaatcacagtaacaaccaccgcatcaggaacacgggcaatttccggcctcctgtggctaaaaaacccactatagctgtgaagcccactatgatagtggcagatgggcaaagtatatgtggtgagcttagcatccaagaacactgtgagaacaaacctgtcatcatagggtggaaccgaaacagagctgccttgagtcagaaaccacttaacaataataatgaagatgatgaaggaattagccatgttcctaagccttatggcaataatgatagtgcaaagaagatgtcagataacaataatggactaactgaagtgttaaaggagatagcaggcttggatactgcccctcagataagaggaaatgaaacaaactccagagaaacattcttgggaagaataaatgattgctataaacgatcattggaaagaaagcttccaccaagttgcatgataggtgggataaaggaaactcagggcaagcatgttattctgagtgggagcacagaagtgattagtaatgaagggggccggttctgttacccagagttttccagtggcgaggagagtgaagaggatgtacttttcagtaacatggaggaggagcacgagagttgggatgagagtgatgaagagctgttggccatggagattcgcatgagagggcaacctcgctttgccaacttcagagcaaacacattgtctcctgttcgattctttgtggacaaaaaatggaataccatccccctgcgaaacaagtctctgcagagaatctgtgctgtggactatgatgacagctatgatgaaatcctgaatggttatgaggaaaattctgtggtctcttatggacaaggaagcattcagagcatggtgtcatctgactccacatcaccagattcttctttaacagaagaatcacgttctgagacagccagtagtttatcccagaagatttgtaatgggggattatctcctggtaacccaggagattctaaggacatgaaggaaattgagcccaattatgaaagtccctctagtaataatcaggataaagattcatcacaggcttccaaaagctcaataaaagttccagagacccacaaagcagtccttgctctccgattagaagagaaagatggcaagattgctgtacaaactgagaaggaagaaagtaaagcctctacagatgttgctgggcaagcagtaaccataaaccttgtccccacagaagagcaagcaaaaccttaccgagttgtgaacctggaacagccattgtgcaagccatatactgtcgtggatgtgtcagcagccatggccagtgagcacctcgagggccctgttaacagccccaagacaaaaagctcatcctctactccaaactctccagttacatcatcttcattgacaccaggacaaataagtgcccatttccaaaaatccagtgcaattcgataccaagaagtatggacttctagcaccagtccacgacaaaagatacctaaagtagaactaattactagtggaactggaccaaatgttcctccaaggaaaaactgtcacaaatcagcacctacatcacccacagctacaaacatttcctccaaaaccatccctgttaagtcacctaatttgtctgaaattaaatttaatagttataacaatgctggtatgccaccttttccaattatcattcatgacgagccaacttatgctcggagttccaaaaatgctatcaaagttcccattgttatcaatccaaatgcatatgacaatctagctatctacaaaagttttctgggaacaagtggagaactctcagtgaaggaaaaaa

SEQ ID NO: 172294 - DNA, 2140 bp, Homo sapiens
  Payload ID: 13874
  Gene Symbol: PUDP
  Gene Name: pseudouridine 5'-phosphatase
  Uniprot ID: Q08623
  ENST ID: ENST00000381077
  CDS Start-End: 78-764
ctcagtgcgcgtgcgcggggcgggcgggtgcgcgcgcacttcctcctcgcccccacccagacccagaaggcgccaccatggcggcgcccccgcagcccgtcacccacctcatctttgacatggacggacttcttctggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacatgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatgtttatatctatcgtctgcatcactctcctcagtgttgatgtcaacatgcaatgacaactgataaagcgagatggtagttctgcctggtttgcagtctgagtgggaaagtcctgtttttgatgagcactccttgttagctaacatttaaattctttttgtgacctcagaatgtctctggatctttcctcattgactgactctgtgccacgtcatccatagtttattgttagtatgaacacaactgtaacatttacctggtatctacatccttacctgcattggaaaatgtttgctacctcacaacaaccatttgcctcctttaagaacactgatgggctgcactttttggatagaaatagaatttgatttcagaatgtatgcttggtgagtctcagtgcccaggaacacttttggaataatttatcagacattgaacttctgtgattaatcgcttttatagatttactcagtctttaaaattcgtctctgatttgccagagaaaaacggtggtagccatggaaatcgggagtgaaggagcactgcttcattgtggctcagcccttcctaggggcctctgccctttgatgtccttgagctactcttcagctctggaagttgtggacaaaccgtaggaatgtatgtgtgcgtgtggtggagtgattgtctgtgaatgacaggccctggctattgattgatgttgcatcaatttagcaaattcatttcctcattcttgatggcctgaatatatgtctgcacttttaatgctcctcttaaccagttgtaacatcttaccatttccctaacaaattgaattagtttaataaaatcttttgacacatgtt

SEQ ID NO: 172295 - DNA, 1334 bp, Homo sapiens
  Payload ID: 13874
  Gene Symbol: PUDP
  Gene Name: pseudouridine 5'-phosphatase
  Uniprot ID: Q08623
  ENST ID: ENST00000424830
  CDS Start-End: 46-801
cgcgcacttcctcctcgcccccacccagacccagaaggcgccaccatggcggcgcccccgcagcccgtcacccacctcatctttgacatggacggacttcttctgggttatacaggaagcatagtggcagctgcttcgggggagtcctcaagaggcttacaatcacggtggacggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacatgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatg

SEQ ID NO: 172296 - DNA, 1376 bp, Homo sapiens
  Payload ID: 13874
  Gene Symbol: PUDP
  Gene Name: pseudouridine 5'-phosphatase
  Uniprot ID: Q08623
  ENST ID: ENST00000412827
  CDS Start-End: 41-598
acttcctcctcgcccccacccagacccagaaggcgccaccatggcggcgcccccgcagcccgtcacccacctcatctttgacatggacggacttcttctggatactgaacggctgtattcagtggtgtttcaagaaatatgtaatcgctatgacaagaaatacagctgggatgtaaagtccctggttatgggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagtgccttgtctttgaagatgctcccaatggggtggaggcggccctggcagctgggatgcaggtggtcatggttcctgacggaaacttgagccgagatctgacaacaaaggccaccctggtgctgaattccctgcaggacttccagcccgagctgtttggtttgccctcctatgagtgagagggagggcctcagtcttccgcccccagcccactctcatggtccacactgctgggggaaagggaaaggaaatcagcaactcttcaatcccaacctgcgctgtgattttagcctcctgagattggagtttccatcccatgttggtttgtcccagtctaacgtgttgataaaatgtgacttgacggttgagacaaaaaatacagtagagacagaaacgaagcccagaacaaagatgaaacttgaattaccatctcagaagtcaagctgatggagtatgtgataaagtgaatgtacatgtatatacacacacacctccatatatacatgtgtgtatcagtttggtaatatgcaggtaggcattacatgcatatgtatgtagacatatgcatgcatgtatatgtaaaatatatacttttccaagacaaaatggaacatcacttctctcttctagtttttctgaacactggctgggaaatgtaaactgtgtatgcatataagtatatgctttatgtatgcatatgtatgtagatatgtttatatctatcgtctgcatcactctcctcagtgttgatgtcaacatgcaatgacaactgataaagcgagatggtagttctgcctggtttgcagtctgagtgggaaagtcctgtttttgatgagcactccttgttagctaacatttaaattctttttgtgacctcagaatgtctctggatctttcctcattgactgactctgtgccacgtcatccatagtttattgttagtatgaacacaactgt

SEQ ID NO: 172297 - DNA, 586 bp, Homo sapiens
  Payload ID: 13874
  Gene Symbol: PUDP
  Gene Name: pseudouridine 5'-phosphatase
  ENST ID: ENST00000486446
  CDS Start-End: 13-586
gaaggcgccaccatggcggcgcccccgcagcccgtcacccacctcatctttgacatggacggacttcttctggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagagctccatccatagacctcgtctgctcaccgcacagaaatgccagggctgccgggatcccttct

SEQ ID NO: 172298 - DNA, 825 bp, Homo sapiens
  Payload ID: 13874
  Gene Symbol: PUDP
  Gene Name: pseudouridine 5'-phosphatase
  Uniprot ID: Q08623
  ENST ID: ENST00000540122
  CDS Start-End: 78-704
ctcagtgcgcgtgcgcggggcgggcgggtgcgcgcgcacttcctcctcgcccccacccagacccagaaggcgccaccatggcggcgcccccgcagcccgtcacccacctcatctttgacatggacggacttcttctggatactgaacggctgtattcagtggtgtttcaagaaatatgtaatcgctatgacaagaaatacagctgggatgtaaagtccctggttatgggtaagaaggcattagaggcggcacagattataatagacgtcttgcagctcccgatgtccaaagaggagctggtggaagaaagccaaacgaagttaaaggaagtgttccccacggctgcgctcatgccaggggcggagaaactcatcatccacctgcggaaacatggcatcccctttgcactggccaccagctcggggtccgcgtcgttcgatatgaagacaagccgccacaaggagttcttcagcttgttttcccacattgtgctgggagatgaccccgaagtgcagcatggcaagccagacccggacatcttcctagcttgtgccaagaggttctctccccctcctgctatggagaagagctccatccatagacctcgtctgctcaccgcacagaaatgccagggctgccgggatcccttctcagcgctcctccttctgtgtaatcaactgcttctctgctctgatgacacctgaccgcacctccagctcacagccacagtgcatggagaccccgagccttctacttgggtgtcccacgatggcctcaaacccaacttgtcacaaaagctacctctccttcctgccaccaaaatgg

SEQ ID NO: 172299 - DNA, 1206 bp, Homo sapiens
  Payload ID: 13875
  Gene Symbol: PUS1
  Gene Name: pseudouridylate synthase 1
  ENST ID: ENST00000322060
  CDS Start-End: 55-1206
ttccgccttcgcccacgtggtccggctccggctcagtcagccgcctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaag

SEQ ID NO: 172300 - DNA, 4094 bp, Homo sapiens
  Payload ID: 13875
  Gene Symbol: PUS1
  Gene Name: pseudouridylate synthase 1
  Uniprot ID: Q9Y606
  ENST ID: ENST00000376649
  CDS Start-End: 501-1784
gtgcagtcggtcgttccacttccgccttcgcccacgtggtccggctccggctcagtcagccgcgtcgcgaatggggcaggagcgagcctctctggtcccgacgcgggtggcccgggtctcctcgactcctgaggaaagcccaccgggcggggcgggaggtgaagaggctggggaagtcagaggttaacctgggcgtcaggggacgttggagttgatccgtcagggtcccggggcggtctgggggcagtagagacggggcttgggcgcggggcctgagaggtcaggggtcagcaggagtgaggctggggcgtccaggtccgagaggtcaggggtcagctggagaggggctggggcgccggtttcccggaggtcaggggtcagaaggaacagggctgcagcgtcagggtccgagaggttaggggtcggcagaggcggagctggggcactgggggtcaggggtcggggatcagggcggggtcgggtgcactggtagcctgcgcatgggcctccagcttcgcgcgctgttgggagccttcggacggtggaccctgcgcctgggaccgcgtccgtcctgctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaatccttggtttgcctttttcttagtcttttttaacatttttttcgtccacagagatgagcacagcatggtgtcccgttgagaacagatacggctgaacaaaagagaaaggcccaggaggttggctcagcctgtaatcccagcacttgggaggctgaggtgggcagatcgcttgagtacaggagttccagaccagcctgggtaaaatggtgaaaccgcgtctctgcaaaagattagctgggcatggcggcatgccctgtagttcagctgctcaggaggctgaggtgggaggattgcctgagtctggagaagtcgaggctgccctgattgccactgcactcaaaaaaaaaaaaaacaacaacaaccaaaaaaactggccaggcgtggtggctcatgcctgtaatcccaacacttcgggaggctgaggcaggtggattacttgaggtcgggagtttgagaccagcctgaccagcatggagaaaccccgtctctactaaaaatacaaaaattagctgggcgcgatggtgggcgcctgtaatcccagctacttgggaggctgaggcaggagaatcgcttgaacctgggaggtggagattgcagtgagccaagattgcgccactgcactccagcctgggtgagagagccaaactccgtcaaaaaaaaaacaacaaaaaaacccagcatcctgcactctgcagggtggtcccgaggcagggctgtggagggcactgaagcaggggccccgctgacctgccgcatccccgagaggggtggcagccacgggctcctcttcctagacagccccatgcgtgcagcctttgccctggttgcaggtcggtactcgcctcagcactgtcccggtgccaggcaggtgggggttggggcagagggcagaaggaaagggtgcatcgcggaacaggcccttagtggagcttactggaagaccccaccagccgctgctgcacgtcattggtcacaggtgcatccagcggcccttcgtagctgcaagggaggctggggaagactgcttttgaagtggcgcttagcgtggaacaaaacacactgcgttagccaggagcaggggatccttggctggcgggctgccaggagcccagggaggggctcagcggaggaagtgccgtgcatacacgtggcctcccagcctgcagcccgtgggcgcacgtgaccaatgcacgagtgcctgatgccccagcggtgcacacaactaatgcgcatgcgcctgacgtgccaacaatgcatgtgactaatgcgcagtcgcctgtcgccccagcagtgcgtgagtgacatgtgcacgtgcccatgatgcggtggacaccgtgtgtgagaagtggggcaggacaggtgggattgggagatgcttcaggcagtgagctcctagggcgtggggtgcccaagagagtggagctggttttagggattttggccagaggagcagtggggctcactgcttcgggagccagggagtgcaggtgtgaggcccactgggctttgggtttgagggatggatgagctgggccgttaactggaacgggagacagggaaaggaatgggtttggagaacaagcaggagcttggttctaagcatgttaattttacctgggatagacaggactttattttttatttttattttgtttgagacggagtctcgctgtgttgcccagcctggagtgcagtggcgcgatctcggctcactgcaacctgcgcctcccgggctcaagcgattctccttcctcagcctccagagtagctgagagtacaggtgcccgctgccacgcccggctgatttttgtatttttggtagagacagggtttcaccatgttggtcaggctggtctcaaactcctaagctcaggtgatccacccgccttggcctcccaaagtgctgggattacaggcgtgagccaccgtgcccggcctgggtgacccatttaaatcacttttgatgatcctggggtatgtgacattttaaaataatatgtatatatggaaggaaataaaaaactataaaaaagggaa

SEQ ID NO: 172301 - DNA, 1664 bp, Homo sapiens
  Payload ID: 13875
  Gene Symbol: PUS1
  Gene Name: pseudouridylate synthase 1
  Uniprot ID: Q9Y606
  ENST ID: ENST00000443358
  CDS Start-End: 192-1391
agttttgtccgcgctcggccgccgtgcagtcggtcgttccacttccgccttcgcccacgtggtccggctccggctcagtcagccgcgtcgcgaatggggcaggagcgagcctctctggtcccgacgcgggtggcccgggtctcctcgactcctgaggaaagcccaccgggcggggcgggagctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaa

SEQ ID NO: 172302 - DNA, 577 bp, Homo sapiens
  Payload ID: 13875
  Gene Symbol: PUS1
  Gene Name: pseudouridylate synthase 1
  ENST ID: ENST00000456665
  CDS Start-End: 109-577
agcctctctggtcccgacgcgggtggcccgggtctcctcgactcctgaggaaagcccaccgggcggggcgggaggtgaagaggctggggaagtcagagctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagagtcaggatctcattctgttgcccaggctggagtgcagtggcatgatcatggctcactgcagtctcaaactgctgggctcaagcaatcctcctgcctcagcctcccgagtag

SEQ ID NO: 172303 - DNA, 2151 bp, Homo sapiens
  Payload ID: 13875
  Gene Symbol: PUS1
  Gene Name: pseudouridylate synthase 1
  ENST ID: ENST00000542167
  CDS Start-End: 754-1878
agtcagccgcgtcgcgaatggggcaggagcgagcctctctggtcccgacgcgggtggcccgggtctcctcgactcctgaggaaagcccaccgggcggggcgggaggtgaagaggctggggaagtcagaggttaacctgggcgtcaggggacgttggagttgatccgtcagggtcccggggcggtctgggggcagtagagacggggcttgggcgcggggcctgagaggtcaggggtcacctcctgagtcactgggattaaaagcatacctaattatttatttatttatttatttttgagacagagttttcctctgtcacctaggctggagtgcagtggtacattatcagttcactgcaacctccacttcccaggttcaagcgattctcctgcctcaagagcccggcaccacgcccggctaatttttgtatttttagtagagacagagtttcaccatgttggccagactggtctcgaactcctgatctcaagtgatccaccctcctcggcctcccaaagtgctgggattacaggtgtgagccactgcacctggccatagattactttatagtcaatgttttttttttaaagtataggtagcacccacggcactgattttgtaactgacagattgtggaagtaggtgtatgcacaggttcaatcaaacctgtgttttgattccattccacactacccaccccctagcatggagcagcccggccccagggtgagtgagcagaaaacagtgttttcacatgagcgtggcagctcacacttgtaatctcagcacttcaggaggccagaggagtaagcggccaggagttcgagaccagcctgggcaacatcatggcgacctctgtctgcaaaatataaaatctgtttttgtctcctttttccagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaa

SEQ ID NO: 172304 - DNA, 642 bp, Homo sapiens
  Payload ID: 13875
  Gene Symbol: PUS1
  Gene Name: pseudouridylate synthase 1
  ENST ID: ENST00000537484
  CDS Start-End: 43-642
tggaccctgcgcctgggaccgcgtccgtcctgctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagagtcaggatctcattctgttgcccaggctggagtgcagtggcatgatcatggctcactgcagtctcaaactgctgggctcaagcaatcctcctgcctcagcctcccgagtaggactgaagcgggtcacgggcgggtttaactccaagaacagatgtgatgccaggacctattgctacctgctgcccacgtttgcctttgcgcacaaggaccgggacgttcaggatgagacctaccgcctgagc

SEQ ID NO: 172305 - DNA, 631 bp, Homo sapiens
  Payload ID: 13875
  Gene Symbol: PUS1
  Gene Name: pseudouridylate synthase 1
  ENST ID: ENST00000538037
  CDS Start-End: 172-631
ccgcgtcgcgaatggggcaggagcgagcctctctggtcccgacgcgggtggcccgggtctcctcgactcctgaggaaagcccaccgggcggggcgggagcttcgcgcgctgttgggagccttcggacggtggaccctgcgcctgggaccgcgtccgtcctgctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgg

SEQ ID NO: 172306 - DNA, 838 bp, Homo sapiens
  Payload ID: 13875
  Gene Symbol: PUS1
  Gene Name: pseudouridylate synthase 1
  ENST ID: ENST00000535067
  CDS Start-End: 163-567
cttcggacggtggaccctgcgcctgggaccgcgtccgtcctggtaatgaccgcgacgccgggcgaccccgctatgcccgcccagcccagcccaccccagtccaccccgcgcggtgccgagcgggcccccgctcacgccgcccttctccgcagctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttcccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtc

SEQ ID NO: 172307 - DNA, 687 bp, Homo sapiens
  Payload ID: 13875
  Gene Symbol: PUS1
  Gene Name: pseudouridylate synthase 1
  ENST ID: ENST00000544213
  CDS Start-End: 135-687
gaggtcaggggtcagaaggaacagggctgcagcgtcagggtccgagaggttaggggtcggcagaggcggagctggggcactgggggtcaggggtcggggatcagggcggggtcgggtgcactggtagcctgcgcatgggcctccagcttcgcgcgctgttgggagccttcggacggtggaccctgcgcctgggaccgcgtccgtcctgctcgccgcgcatggccgggaacgcggagccgccgcccgccggagccgcatgcccccaggaccggaggtcctgcagcggccgggccgggggcgaccgcgtctgggaggacggagaacatccggcgaagaagctcaagagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagagtcaggatctcattctgttgcccaggctggagtgcagtggcatgatcatggctcactgcagtctcaaactgctgggctcaagcaatcctcctgcctcagcctcccgagtag

SEQ ID NO: 172308 - DNA, 2278 bp, Homo sapiens
  Payload ID: 13876
  Gene Symbol: PUS10
  Gene Name: pseudouridylate synthase 10
  Uniprot ID: Q3MIT2
  ENST ID: ENST00000316752
  CDS Start-End: 263-1852
gagactttgctccctgtcgatgccgtggctggacaaatgccgctctcaactgctacagaccaaagtctacgctttaaagatagagaagccattctgtcaaagtgaaaacagaagcggtaggtaggaagccgcccccctttctttcaagcacagagacccagagagacgcccaggagctcccgaaaaaaacgttgctgattagagctgccgggtcagaaacagctgtgagacactaaagtccccactgttataattattcaatatgttcccactgactgaggaaaacaagcatgtggcccagttgttgctcaatactggtacttgtccaagatgtatcttcagattctgtggtgtggattttcatgcaccttacaaacttccatacaaggagttgctcaatgaactacagaaatttctggaaactgaaaaagatgaattaattttggaagttatgaacccacctcccaagaaaattcgactgcaagaactggaagatagtattgataatctaagtcaaaatggagagggaaggatctctgttagtcatgttggaagcactgcttccaagaactcaaatttaaatgtatgtaatgtatgcctaggaattcttcaagaattctgtgagaaagatttcattaaaaaggtgtgccaaaaggttgaggcctctgggtttgaattcaccagcttggtattttcagtctccttcccaccacaactatctgtaagagagcatgctgcatggttgctggtaaaacaggaaatgggaaagcagagtctgtcgctgggaagagatgatatagttcagctaaaagaagcctacaaatggataactcaccccctgttttcagaggaactgggtgttcccattgatggaaagagcttgtttgaagtgagtgtggtctttgctcacccagaaacagttgaggattgccacttcctagctgcgatatgcccagattgttttaagccagccaaaaacaaacagtctgtattcactagaatggcagttatgaaagccttgaataagataaaggaagaggatttccttaagcagtttccttgtcctccaaactcaccaaaggctgtatgcgctgttcttgaaattgaatgtgctcatggtgctgtttttgtggctgggagatataataaatactccaggaatctaccacaaactccttggataattgatggagaaaggaagctggaatcttcagtggaagaattaatttcagatcatctgttggcagtatttaaagcagagagttttaatttttcatcctctggaagagaagatgtagatgtgagaacattaggaaatggaaggccctttgcaattgagctggtgaatcctcatagagtacatttcacttcacaagaaattaaggaacttcagcagaaaattaataactcatctaacaaaatccaagtacgtgacttgcagcttgtcacaagagaggcaataggacatatgaaagaaggtgaagaagaaaagacaaagacctacagtgccttaatttggacaaataaagcgatacagaagaaagacattgaattcctaaatgacataaaggacttaaaaatcgaccagaaaacacctttgcgcgtccttcaccgaaggcccctggctgtgcgagctcgcgtcattcacttcatggagacacagtacgtggatgagcaccacttccgcctccacttgaaaactcaggctggcacctacattaaagagtttgtacatggagacttcgggagaaccaagccaaacattgggtccctgatgaatgtgactgcagacattctggagctggatgttgagtctgtagatgttgactggccacctgctctggatgactagctttcaaatttggagacaaagagtatggttttcctggcatgatgtggacatccatggagcacatgccgtaaaatggctgtttacccaccataacggtgtcttgaaaactatttggatcatgttgatctatataattgttaatttgttgtaacatctcaggatctatatatgtgtatattttgtgttaaattgttccaaggatgtcttaggatttttctcattccctctttcacccccacaaaccaaactatgaataatgaaataattctccttaattctttcatttagagaggtgcacaaacaggacacattctctgttaacctaagaagctgtaatttcagcaagatttccctccacaagagatataccacctttaaaatcatgttctaatttttgtaaattatctgaataaaagttatatctag

SEQ ID NO: 172309 - DNA, 1227 bp, Homo sapiens
  Payload ID: 13876
  Gene Symbol: PUS10
  Gene Name: pseudouridylate synthase 10
  ENST ID: ENST00000398658
  CDS Start-End: 61-249
ggggttaaatctcaggctccggcgtctggggagaaggtgaggcggttataattattcaatatgttcccactgactgaggaaaacaagcatgtggcccagttgttgctcaatactggtacttgtccaagatgtatcttcagattctgtggtgtggattttcatgcaccttacaaacttccatacaagatgaagaaactgagatacagagaggttaagcaacctgcccaaagttacacagctattaagtgagcaagctaggatttgaacagtctgactgaattcaaaacctaggatttggaactagaagacatggatttgaatcccagttccaccactttccagcttcagtttactcctctgtaaatgggaatgatgataatacccacctcacaggactttaagggacaatacctaataaagtacgtggaaacactttgaaaaccagaaattggctgggtgcggtggctcacgcctgtaatcctagcactttgggaggccgaggcgggtggatcacgaggtcaggggttcaagaccagcctggccaagatgatgaaaccctgtctctactaaaaatacaaatattagctgggcgccatggcaggtgcctgtgatcccagctacttgggaggctgaggcaggagaattgcttgaacccaggggtggggggtgcggaggttgcagtgagccgagatcatgccactgcactctagcctgggcaacagtgtgagactccgtctgaaaattaaaaaaacaaaaacaaaaaaccagaaatggtacttgtgctatgatgatttaaatatgtgtatattcatttatacacaatatgactgtaaagtaataagactggttttgtgtaaccctgcttacacatttttttcagacacactgtaacctattatctattatatgttattaggttttaaatttatattatattaagagactgagtgttatcaactttcgtttgtttcattttatgtaaggcaatatacaagaatatttggacagctttttggaaatgttcataaattttgatctgttctattcatgtaactatgtatgtacatgcacatctgtatatgcactatgttatatctatattatagatcttaggtaacaacaaacatatttgtgtgagtcaaaatgtacctgtatatgtatgtatgtatgtatatttctctgttaaagcaggagagctaatttctcaataaaatggatttaaatttg

SEQ ID NO: 172310 - DNA, 1820 bp, Homo sapiens
  Payload ID: 13876
  Gene Symbol: PUS10
  Gene Name: pseudouridylate synthase 10
  Uniprot ID: Q3MIT2
  ENST ID: ENST00000407787
  CDS Start-End: 61-1650
ggggttaaatctcaggctccggcgtctggggagaaggtgaggcggttataattattcaatatgttcccactgactgaggaaaacaagcatgtggcccagttgttgctcaatactggtacttgtccaagatgtatcttcagattctgtggtgtggattttcatgcaccttacaaacttccatacaaggagttgctcaatgaactacagaaatttctggaaactgaaaaagatgaattaattttggaagttatgaacccacctcccaagaaaattcgactgcaagaactggaagatagtattgataatctaagtcaaaatggagagggaaggatctctgttagtcatgttggaagcactgcttccaagaactcaaatttaaatgtatgtaatgtatgcctaggaattcttcaagaattctgtgagaaagatttcattaaaaaggtgtgccaaaaggttgaggcctctgggtttgaattcaccagcttggtattttcagtctccttcccaccacaactatctgtaagagagcatgctgcatggttgctggtaaaacaggaaatgggaaagcagagtctgtcgctgggaagagatgatatagttcagctaaaagaagcctacaaatggataactcaccccctgttttcagaggaactgggtgttcccattgatggaaagagcttgtttgaagtgagtgtggtctttgctcacccagaaacagttgaggattgccacttcctagctgcgatatgcccagattgttttaagccagccaaaaacaaacagtctgtattcactagaatggcagttatgaaagccttgaataagataaaggaagaggatttccttaagcagtttccttgtcctccaaactcaccaaaggctgtatgcgctgttcttgaaattgaatgtgctcatggtgctgtttttgtggctgggagatataataaatactccaggaatctaccacaaactccttggataattgatggagaaaggaagctggaatcttcagtggaagaattaatttcagatcatctgttggcagtatttaaagcagagagttttaatttttcatcctctggaagagaagatgtagatgtgagaacattaggaaatggaaggccctttgcaattgagctggtgaatcctcatagagtacatttcacttcacaagaaattaaggaacttcagcagaaaattaataactcatctaacaaaatccaagtacgtgacttgcagcttgtcacaagagaggcaataggacatatgaaagaaggtgaagaagaaaagacaaagacctacagtgccttaatttggacaaataaagcgatacagaagaaagacattgaattcctaaatgacataaaggacttaaaaatcgaccagaaaacacctttgcgcgtccttcaccgaaggcccctggctgtgcgagctcgcgtcattcacttcatggagacacagtacgtggatgagcaccacttccgcctccacttgaaaactcaggctggcacctacattaaagagtttgtacatggagacttcgggagaaccaagccaaacattgggtccctgatgaatgtgactgcagacattctggagctggatgttgagtctgtagatgttgactggccacctgctctggatgactagctttcaaatttggagacaaagagtatggttttcctggcatgatgtggacatccatggagcacatgccgtaaaatggctgtttacccaccataacggtgtcttgaaaactatttggatcatgttgatctatataattgttaatttgttgtaacatctcaggatctatatat

SEQ ID NO: 172311 - DNA, 571 bp, Homo sapiens
  Payload ID: 13876
  Gene Symbol: PUS10
  Gene Name: pseudouridylate synthase 10
  ENST ID: ENST00000421319
  CDS Start-End: 211-571
agtcgggctgggagtaaagccgcacgcactccttcgctcgtgggggaggtagggtgaggtggcaaaccaggcagtttttcggatttcctctacaaacaagaagggagaagctcacttagtcctagcgagagcgggctggtacttttgttctaaaacgcacgtttcctcggggaacagaattgctagacgcaatagttataattattcaatatgttcccactgactgaggaaaacaagcatgtggcccagttgttgctcaatactggtacttgtccaagatgtatcttcagattctgtggtgtggattttcatgcaccttacaaacttccatacaaggagttgctcaatgaactacagaaatttctggaaactgaaaaagatgaattaattttggaagttatgaacccacctcccaagaaaattcgactgcaagaactggaagatagtattgataatctaagtcaaaatggagagggaaggatctctgttagtcatgttggaagcactgcttccaagaactcaaatttaaatgtatgtaatgtatgcctaggaattcttcaagaattctgtg

SEQ ID NO: 172312 - DNA, 658 bp, Homo sapiens
  Payload ID: 13876
  Gene Symbol: PUS10
  Gene Name: pseudouridylate synthase 10
  ENST ID: ENST00000430495
  CDS Start-End: 65-253
ggggttaaatctcaggctccggcgtctggggagaaggtgaggcgggtagttataattattcaatatgttcccactgactgaggaaaacaagcatgtggcccagttgttgctcaatactggtacttgtccaagatgtatcttcagattctgtggtgtggattttcatgcaccttacaaacttccatacaagatgaagaaactgagatacagagaggttaagcaacctgcccaaagttacacagctattaagtgagcaagctaggatttgaacagtctgactgaattcaaaacctaggatttggaactagaagacatggatttgaatcccagttccaccactttccagcttcagtttactcctctgtaaatgggaatgatgataatacccacctcacaggactttaagggacaatacctaataaagagttgctcaatgaactacagaaatttctggaaactgaaaaagatgaattaattttggaagttatgaacccacctcccaagaaaattcgactgcaagaactggaagatagtattgataatctaagtcaaaatggagagggaaggatctctgttagtcatgttggaagcactgcttccaagaactcaaatttaaatgtatgtaatgtatgcctaggaattcttcaagaattctgtg

SEQ ID NO: 172313 - DNA, 1843 bp, Homo sapiens
  Payload ID: 13877
  Gene Symbol: PUS3
  Gene Name: pseudouridylate synthase 3
  Uniprot ID: Q9BZE2
  ENST ID: ENST00000227474
  CDS Start-End: 99-1544
gcacagtgacagcttcctttctcggaaacgcggcgcggccggctgccggaaaacagggcagacctgtatggttcgtttattcctggggttgtcatatcatggcttataatgacacagacagaaaccagactgagaagctcctaaaaagagtacgagaactggagcaagaggtgcaaagacttaaaaaggaacaggccaaaaataaggaggactcaaacattagagaaaattcagcaggagctggaaaaactaagcgtgcatttgatttcagtgctcatggccgaagacacgtagccctaagaatagcctatatgggctggggataccagggctttgctagtcaggaaaacacaaataataccattgaagagaaactgtttgaagctctaaccaagactcgactagtagaaagcagacagacatccaactatcaccgatgtgggagaacagataaaggagttagtgcctttggacaggtgatctcacttgaccttcgctctcagtttccaaggggcagggattccgaggactttaatgtaaaagaggaggctaatgctgctgctgaagagatccgttatacccacattctcaatcgggtactccctccagacatccgtatattggcctgggcccctgtagaaccaagcttcagtgctaggttcagctgccttgagcggacttaccgctattttttccctcgtgctgatttagatattgtaaccatggattatgcagctcagaagtatgttggcacccatgatttcaggaacttgtgtaaaatggatgtagccaacggtgtgattaattttcagaggactattctatctgctcaagtacagctagtgggccagagcccaggtgaggggagatggcaagaacctttccagttatgtcagtttgaagtgactggccaggcattcctttatcatcaagtccgatgtatgatggctatcctctttctgattggccaaggaatggagaagccagagattattgatgagctgctgaatatagagaaaaatccccaaaagcctcaatatagtatggctgtagaatttcctctagtcttatatgactgtaagtttgaaaatgtcaagtggatctatgaccaggaggctcaggagttcaatattacccacctacaacaactgtgggctaatcatgctgtcaaaactcacatgttgtatagtatgctacaaggactggacactgttccagtaccctgtggaataggaccaaagatggatggaatgacagaatggggaaatgttaagccctctgtcataaagcagaccagtgcctttgtagaaggagtgaagatgcgcacatataagcccctcatggaccgtcctaaatgccaaggactggaatcccggatccagcattttgtacgtaggggacgaattgagcacccacatttattccatgaggaagaaacaaaagccaaaagggactgtaatgacacactagaggaagagaatactaatttggagacaccaacgaagagggtctgtgttgacacagaaattaaaagcatcatttaaccatagacaatttgccaggatctaggaaccacctaatggtaggtggacagaaaaggaaaaaaaaaaaaatttacttgcaagtactaggaattcagatgatcagctcttaaaagaaaaaaaaaagcaaaaagactaaagccctattaaggaagttattgctttaataagaaatttcaaatattctcttatcccggtccaaaaggattaagcgattaaagaacgtaaaatggagatgtatttacatacacctggaaacctgtgccttgtattcaaattcattaaagcctaatcctgcaagt

SEQ ID NO: 172314 - DNA, 605 bp, Homo sapiens
  Payload ID: 13877
  Gene Symbol: PUS3
  Gene Name: pseudouridylate synthase 3
  ENST ID: ENST00000534158
  CDS Start-End: 99-605
gcacagtgacagcttcctttctcggaaacgcggcgcggccggctgccggaaaacagggcagacctgtatggttcgtttattcctggggttgtcatatcatggcttataatgacacagacagaaaccagactgagaagctcctaaaaagagtacgagaactggagcaagaggtgcaaagacttaaaaaggaacaggccaaaaataaggaggactcaaacattagagaaaattcagcaggagctggaaaaactaagcgtgcatttgatttcagtgctcatggccgaagacacgtagccctaagaatagcctatatgggctggggataccagggctttgctagtcaggaaaacacaaataataccattgaagagaaactgtttgaagctctaaccaagactcgactagtagaaagcagacagacatccaactatcaccgatgtgggagaacagataaaggagttagtgcctttggacaggtgatctcacttgaccttcgctctcagtttccaaggggcagggattccgaggactttaatgtaaaagaggaggctaatgctgctgctgaagagatccgttatacccacattctcaatcgggtactccct

SEQ ID NO: 172315 - DNA, 1792 bp, Homo sapiens
  Payload ID: 13877
  Gene Symbol: PUS3
  Gene Name: pseudouridylate synthase 3
  Uniprot ID: Q9BZE2
  ENST ID: ENST00000530811
  CDS Start-End: 47-1492
acagggcagacctgtatggttcgtttattcctggggttgtcatatcatggcttataatgacacagacagaaaccagactgagaagctcctaaaaagagtacgagaactggagcaagaggtgcaaagacttaaaaaggaacaggccaaaaataaggaggactcaaacattagagaaaattcagcaggagctggaaaaactaagcgtgcatttgatttcagtgctcatggccgaagacacgtagccctaagaatagcctatatgggctggggataccagggctttgctagtcaggaaaacacaaataataccattgaagagaaactgtttgaagctctaaccaagactcgactagtagaaagcagacagacatccaactatcaccgatgtgggagaacagataaaggagttagtgcctttggacaggtgatctcacttgaccttcgctctcagtttccaaggggcagggattccgaggactttaatgtaaaagaggaggctaatgctgctgctgaagagatccgttatacccacattctcaatcgggtactccctccagacatccgtatattggcctgggcccctgtagaaccaagcttcagtgctaggttcagctgccttgagcggacttaccgctattttttccctcgtgctgatttagatattgtaaccatggattatgcagctcagaagtatgttggcacccatgatttcaggaacttgtgtaaaatggatgtagccaacggtgtgattaattttcagaggactattctatctgctcaagtacagctagtgggccagagcccaggtgaggggagatggcaagaacctttccagttatgtcagtttgaagtgactggccaggcattcctttatcatcaagtccgatgtatgatggctatcctctttctgattggccaaggaatggagaagccagagattattgatgagctgctgaatatagagaaaaatccccaaaagcctcaatatagtatggctgtagaatttcctctagtcttatatgactgtaagtttgaaaatgtcaagtggatctatgaccaggaggctcaggagttcaatattacccacctacaacaactgtgggctaatcatgctgtcaaaactcacatgttgtatagtatgctacaaggactggacactgttccagtaccctgtggaataggaccaaagatggatggaatgacagaatggggaaatgttaagccctctgtcataaagcagaccagtgcctttgtagaaggagtgaagatgcgcacatataagcccctcatggaccgtcctaaatgccaaggactggaatcccggatccagcattttgtacgtaggggacgaattgagcacccacatttattccatgaggaagaaacaaaagccaaaagggactgtaatgacacactagaggaagagaatactaatttggagacaccaacgaagagggtctgtgttgacacagaaattaaaagcatcatttaaccatagacaatttgccaggatctaggaaccacctaatggtaggtggacagaaaaggaaaaaaaaaaaaatttacttgcaagtactaggaattcagatgatcagctcttaaaagaaaaaaaaaagcaaaaagactaaagccctattaaggaagttattgctttaataagaaatttcaaatattctcttatcccggtccaaaaggattaagcgattaaagaacgtaaaatggagatgtatttacatacacctggaaacctgtgccttgtattcaaattcattaaagcctaatcctgcaagta

SEQ ID NO: 172316 - DNA, 579 bp, Homo sapiens
  Payload ID: 13877
  Gene Symbol: PUS3
  Gene Name: pseudouridylate synthase 3
  ENST ID: ENST00000529801
  CDS Start-End: 265-579
gcacagtgacagcttcctttctcggaaacgcggcgcggccggctgccggaaatagagacggggtttcgccgtgttagccaggatggtctcgatctcctgacctcgtgatccgcccgcctcagcctcccaaagtgctgggattacaggcgtgagccaccgcgcccggcttgttccttcttttgagctctcatcatagcccaggttcaagatcatcttagacagggcagacctgtatggttcgtttattcctggggttgtcatatcatggcttataatgacacagacagaaaccagactgagaagctcctaaaaagagtacgagaactggagcaagaggtgcaaagacttaaaaaggaacaggccaaaaataaggaggactcaaacattagagaaaattcagcaggagctggaaaaactaagcgtgcatttgatttcagtgctcatggccgaagacacgtagccctaagaatagcctatatgggctggggataccagggctttgctagtcaggaaaacacaaataataccattgaagagaaactgtttgaagctctaaccaagactcgactagtagaaagc

SEQ ID NO: 172317 - DNA, 1419 bp, Homo sapiens
  Payload ID: 13877
  Gene Symbol: PUS3
  Gene Name: pseudouridylate synthase 3
  ENST ID: ENST00000613398
  CDS Start-End: 299-1120
gcacagtgacagcttcctttctcggaaacgcggcgcggccggctgccggaaagtgatctcacttgaccttcgctctcagtttccaaggggcagggattccgaggactttaatgtaaaagaggaggctaatgctgctgctgaagagatccgttatacccacattctcaatcgggtactccctccagacatccgtatattggcctgggcccctgtagaaccaagcttcagtgctaggttcagctgccttgagcggacttaccgctattttttccctcgtgctgatttagatattgtaaccatggattatgcagctcagaagtatgttggcacccatgatttcaggaacttgtgtaaaatggatgtagccaacggtgtgattaattttcagaggactattctatctgctcaagtacagctagtgggccagagcccaggtgaggggagatggcaagaacctttccagttatgtcagtttgaagtgactggccaggcattcctttatcatcaagtccgatgtatgatggctatcctctttctgattggccaaggaatggagaagccagagattattgatgagctgctgaatatagagaaaaatccccaaaagcctcaatatagtatggctgtagaatttcctctagtcttatatgactgtaagtttgaaaatgtcaagtggatctatgaccaggaggctcaggagttcaatattacccacctacaacaactgtgggctaatcatgctgtcaaaactcacatgttgtatagtatgctacaaggactggacactgttccagtaccctgtggaataggaccaaagatggatggaatgacagaatggggaaatgttaagccctctgtcataaagcagaccagtgcctttgtagaaggagtgaagatgcgcacatataagcccctcatggaccgtcctaaatgccaaggactggaatcccggatccagcattttgtacgtaggggacgaattgagcacccacatttattccatgaggaagaaacaaaagccaaaagggactgtaatgacacactagaggaagagaatactaatttggagacaccaacgaagagggtctgtgttgacacagaaattaaaagcatcatttaaccatagacaatttgccaggatctaggaaccacctaatggtaggtggacagaaaaggaaaaaaaaaaaaatttacttgcaagtactaggaattcagatgatcagctcttaaaagaaaaaaaaaagcaaaaagactaaagccctattaaggaagttattgctttaataagaaatttcaaatattctcttatcccggtccaaaaggattaagcgattaaagaacgtaaaatggagatgtatttacatacacctggaaacctgtgccttgtattcaaattcattaaagcctaatcctgcaagt

SEQ ID NO: 172318 - DNA, 3480 bp, Homo sapiens
  Payload ID: 13878
  Gene Symbol: PUS7
  Gene Name: pseudouridylate synthase 7 (putative)
  Uniprot ID: Q96PZ0
  ENST ID: ENST00000356362
  CDS Start-End: 216-2201
cgcgtcgctgcgccgcacgtgtgcgagcccggccgccggtgagtcggctggagcgcatctggtcctccgcgcggaaagcgctgcttttgcctggccgccctagccgctggctcatccaagtggccttcgccgctctcttgcgtcccaaccagagcgctggccacctcgccgcccagctcacgccgcgcccgcgctcccaggctccggccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcagaagacatatttacagttttgacagctgaagaaaagcagcgattggaagagctccagctgttcaaaaataaggaaaccagtgttgccattgaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcataatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgggaagtcgttgcatatgatgatcccaaaattccacttttcaacacagatgtggacaacctagaagggaagacaccaccagtttttgcttctgaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacaagtgtttgcttcctggctccctgtgcatttttgtcttagttcagactcatatatggatttcaaatctttgtaataaaaattatttgtatttttaagtttttattagcttaaagaaataatttgcaatatttgtacatgtacacaaatcctgaggttcttaattttagctcagaatataaattagtcaaaatacacttcaggtgcttaaatcagagtaaaatgtcagctttacaataataaaaaaaggactttggtttaaagtagcaggtttaggttttgctacattctcaaaagacagcaggagtatttgacacatctgtgatggagtatacaacaatgcattttaagagcaaatgcaacaaaacaaatctggactatggataaataatttgagagctgccacccacaaatataaatacagtactcatgctgactgaaataataagacatctacaaatttataaacaaaaagtgattgtcattatcctgcttatgtactagattcaggcaagcattatagactttttggttgcggtggcttttgcatttatattatcaatgccttgcaggaacgttgcattgataggcccattttatttttttattttttttttcgagacaggatctcactctgtagcacaggctggattgcagtgcaatcctgcaattctcaatcttgcactgcagcctcgacctcccaggctccagtgactctcccacctcagcctcctaagtagctgggagtacaggcgcgcaccaccacgcctagctgatttttgtatttttttgtagagacgggggtttggccatgttgccgaggctaactcctgggattacaggcatgagctgtgctggccgggtttttttttcttgatgtaaacgtgtacagctgttttattagttaaggtctaatttttactctaggtgccttttatgttcagaactctttccactggactggtatttgctcaaaaataaataatggtagagaagaaaactataaaaatggacaaggctttcttctatcagtagcgtttaccctttgtcaccagtggctttggtatttccatgtctggcattgcataaacttctctggtgtgaaaggataaatatgcctttctaaagttgtatatcaaaattgtatcaatttttattttctatgatttctagaaacaaatgtaataaatatttttaaaatctcctttctactggttatgtaaataaatcaaataaatatatcaaaa

SEQ ID NO: 172319 - DNA, 2356 bp, Homo sapiens
  Payload ID: 13878
  Gene Symbol: PUS7
  Gene Name: pseudouridylate synthase 7 (putative)
  Uniprot ID: Q96PZ0
  ENST ID: ENST00000469408
  CDS Start-End: 240-2225
cgcgtcgctgcgccgcacgtgtgcgagcccggccgccggtgagtcggctggagcgcatctggtcctccgcgcggaaagcgctgcttttgcctggccgccctagccgctggctcatccaagtggccttcgccgctctcttgcgtcccaaccagagcgctggccacctcgccgcccagctcacgccgcgcccgcgctcccaggctccgggttttcttaaatgttttcttggagccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcagaagacatatttacagttttgacagctgaagaaaagcagcgattggaagagctccagctgttcaaaaataaggaaaccagtgttgccattgaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaaggtgtgtggaagggcagctgcttcgaggactttcaaaatatggaatgaagaatatagtctctgcatttggcataatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgggaagtcgttgcatatgatgatcccaaaattccacttttcaacacagatgtggacaacctagaagggaagacaccaccagtttttgcttctgaaggcaaatacagggctctgaaaatggatttttctctacccccttctacttacgccaccatggccattcgagaagtgctaaaaatggataccagtatcaagaaccagacgcagctgaatacaacctggcttcgctgagcagtaccttgtccacagattagaaaacgtacacaagtgtttgcttcctggctccctgtgcatttttgtcttagttcagactcatatatggatttcaaatctttgtaataaaaattatttgtatttttaag

SEQ ID NO: 172320 - DNA, 395 bp, Homo sapiens
  Payload ID: 13878
  Gene Symbol: PUS7
  Gene Name: pseudouridylate synthase 7 (putative)
  ENST ID: ENST00000482157
  CDS Start-End: 1-395
ctcgggaatcttaaaagaaagatactccgacttcgttgttcatgaaataggaaaagatggacggatcagccatttgaatgacttgtccattccagtggatgaggaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaatccaagaaaacattcttggccaaaatctaggggaagttactgccacttcgtactatataaggaaaacaaagacaccatggatgctattaatgtactctccaaatacttaagagtcaagccaaatatattctcctacatgggaa

SEQ ID NO: 172321 - DNA, 2436 bp, Homo sapiens
  Payload ID: 13878
  Gene Symbol: PUS7
  Gene Name: pseudouridylate synthase 7 (putative)
  ENST ID: ENST00000481939
  CDS Start-End: 249-1595
gggccgcggcgcgtcgctgcgccgcacgtgtgcgagcccggccgccggtgagtcggctggagcgcatctggtcctccgcgcggaaagcgctgcttttgcctggccgccctagccgctggctcatccaagtggccttcgccgctctcttgcgtcccaaccagagcgctggccacctcgccgcccagctcacgccgcgcccgcgctcccaggctccgggttttcttaaatgttttcttggagccttaaagatggagatgacagaaatgactggtgtgtcgctgaaacgtggggcactggttgtcgaagataatgacagtggagtcccagttgaagagacaaaaaaacagaagctgtcggaatgcagtctaaccaaaggtcaagatgggctacagaatgactttctgtccatcagtgaagacgtgcctcggcctcctgacactgtcagtactgggaaaggtggaaagaattctgaggctcagttggaagatgaggaagaagaggaggaagatggactttcagaggagtgcgaggaggaggaatcagagagttttgcagacatgatgaagcatggactcactgaggctgacgtaggcatcaccaagtttgtgagttctcatcaagggttctcgggaatcttaaaagaaagatactccgacttcgttgttcatgaaataggaaaagatggacggatcagccatttgaatgacttgtccattccagtggatgaggaggacccttcagaagacatatttacagttttgacagctgaagaaaagcagcgattggaagagctccagctgttcaaaaataaggaaaccagtgttgccattgaggttatcgaggacaccaaagagaaaagaaccatcatccatcaggctatcaaatctctgtttccaggattagagacaaaaacagaggatagggaggggaagaaatacattgtagcctaccacgcagctgggaaaaaggctttggcaaatccaagaaaacattcttggccaaaatctaggggaagttactgccacttcgtactatataaggaaaacaaagacaccatggatgctattaatgtactctccaaatacttaagagtcaagccaaatatattctcctacatgggaaccaaagataaaagggctataacagttcaagaaattgctgttctcaaaataactgcacaaagacttgcccacctgaataagtgcttgatgaactttaagctagggaatttcagctatcaaaaaaacccactgaaattgggagagcttcaaggaaaccacttcactgttgttctcagaaatataacaggaactgatgaccaagtacagcaagctatgaactctctcaaggagattggatttattaactactatggaatgcaaagatttggaaccacagctgtccctacgtatcaggttggaagagctatactacaaaattcctggacagaagtcatggatttaatattgaaaccccgctctggagctgaaaagggctacttggttaaatgcagagaagaatgggcaaagaccaaagacccaactgctgccctcagaaaactacctgtcaaaagatacccagaaataatcgcttaatgtatattcatagctaccaaagctatgtgtggaataacatggtaagcaagaggatagaagactatggactaaaacctgttccaggggacctcgttctcaaaggagccacagccacctatattgaggaagatgatgttaataattactctatccatgatgtggtaatgcccttgcctggtttcgatgttatctacccaaagcataaaattcaagaagcctacagggaaatgctcacagctgacaatcttgatattgacaacatgagacacaaaattcgagattattccttgtcaggggcctaccgaaagatcattattcgtcctcagaatgttagctgacggagtttcactagtcacccaggctggagcacaatagcatgatctcggctcactgcaacttctgcctcccaggttcaagcgattctcctgtctcagcttccagagtagctaggattacaggcacctgccaccacacctggataatttttgtatttttagtagaggcagggtttcaccatattggccaggctggtgtcaaactcctgacttcagggaagtcgttgcatatgatgatcccaaaattccacttttcaacacagatgtggacaacctagaagggaagacaccaccagtttttgcttctggtctcaatgaattatggaattataggaaagagccagcaggtggaatcctatccatggagaaaaagaagaggaagttgcacttagcccaacacatggtatgtaataaaggaaatcctggcaactggcaaacccacggtcaacaaaaagagcagggctgtgccaggaagccatctttagggtaattcattaaggaagcat

SEQ ID NO: 172322 - DNA, 13593 bp, Homo sapiens
  Payload ID: 13879
  Gene Symbol: PUS7L
  Gene Name: pseudouridylate synthase 7-like
  Uniprot ID: Q9H0K6
  ENST ID: ENST00000344862
  CDS Start-End: 105-2210
aattacgcccctgtcggaggctgaaacacttaaggcttccgggcatgcgcacagcgttgtgcaaatgaatgccttccactgaaccgaggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggctttctaaaacagagctaattggactacctcctgaattctcaataggcagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttggatgatcctgtaaatagagcaaagaagtattttcttcaaactgaggatgctaaaggcacactttcattgatgcctgaattcaaagtgcgtgagagagcattgttggaggcattgcaccgctttggcatgaccgaggaaggttgtatccaggcatggttctctttaccccattccatgcgcatattctatgttcacgcatataccagcaaaatttggaatgaggcagtatcttacagacttgaaacctatggagcaagagtagtgcagggtgatttggtctgtttggatgaagacattgatgacgagaatttcccaaatagtaaaattcacctggtaactgaagaggagggatcagctaatatgtatgcaatacatcaggtggttcttccagtacttggatacaatattcagtacccgaagaacaaagtagggcagtggtaccatgacatacttagcagagatggactacagacatgtaggtttaaagtacctactctgaaactgaatataccaggttgctatagacagattttgaaacatccctgtaatctctcataccaactaatggaagatcatgacattgatgtcaaaacgaaaggttcccacattgatgaaacagctttgtctcttttgatctcttttgatcttgatgcttcatgctatgctaccgtttgtctgaaggaaataatgaagcatgacgtttaaaactgatacccttggtataaccatatatatgtcactctttgaaggaaagggggctaaaatgtcttaagcaccttccatgtgttaggaacttcataattgttatctcttttaattttcacagcatcctgagaagttaggatttgatactgtaattttatagaggatatgtaagtgtcagggtccaaatttaaggtccatgtgaccccaaagcctgtgttttttttctattatatgtttcagtgacctttattctgtgtcataaagttacaatcttttaaaaccattaggaatatatataatactgcaagataacatttaagaaaaaaagttgtgaatattcatatcctccagctccttgcttagaacactagtaaaattaggtcgcagtgaagcaaatgttggagagaaagatagatgaagcattttgctaattattattgtccccctttcctgtttttgaaattattgatcagaacaatatacaagggaaatgccatacctctgtttgtgatagataccccagagtagttattacctctttgtgagataagtaatctttgatgaagattgaaatacaatttctcatccaatttttatatcttggcatacgctgaccctcttgaccatttgtaattttttcatattatctaaaacaggtgttagagtcagacagattcattcttagattctagctctgacacttactagtgattttgagtatgttgttgatttttttgtgtgtggttactgatagaatcaagacaattacaacttcataaatgacaaataataggattatctccacattttctgttgctggaggaacaaaacattgtgcccatttgaaaattttaatttttgttggtttaactatcccacattataaatcatccttcaccattttatatcagttaaatatgggtgtgttggggaggaatgactggcatgtagacatgtattgatttaggaagatctgagcatttctttcattgttggtaagatataatgatgaaatttaaaaagcagtatggagcattatatatcagtaatgtgatatatatacttaagccagtttaaccattttgggaaatgttagcattaggaaataaaatccaaaagaaggaagagaagctatatgcaatgcaaaatttgcttattgcaatattttcatatacagacactaaaaacagttttcaaagtccagcattacgtaactaaagtaagtaaaatgatgtgtatcaacttgatggtaaaatatgtagttatttaaaaaagcaatgaacaatttagtttcatgagaaaatgttgccccctaaaagtagaacacatatgttacaactgcaataatactctgaattcatctttcacaaataagagacatgttagcatagtgattaaaagcacagatattggagacaaactaacccagtttgaaccctggcactgccacgtatagcactgcagccttgggaaagttatttaaactcatgggcttcagtttcaacatctgtaaaatgggcatgttaacattgcctacctcataggattactgtgagaattttctaagttaatatatgtaaagcaactttaaaaagtgcctggcacttagttattgttaagtaagtgtctgcagatgcaagtttggaagagaaaagcaaataaatgaaaatcccttcctgttaagatgatggggtatttggattttttttaatactaaaaagttttttttgttatatgttttggcaataaataattctcaatacacaaaattggatattgtagtaccattgattttctttggattactgccatcattttaatgttatattgagaatgaagtgatcctctattaggtagtaaaaaaaatttagaaaaaatgttttattttatatgataaatcgtatcctataaatgtaatcataaaatgagttatatacattattaaatcctagtttttaaaagttttgaatagcaatcagaaaatacgaaagcatgaaaatatatcattgattttactttttttgcctgcagatggcactataattttagacatttattgatttatttagtaaatacttcagcagtgtataaaggaacactaagtttatttcatcaccataaaatgtattgagatatcattcatgtggaatattattttatatgccaataagatgccatgttaaactttttttgtttaaggacttttattattaatagtatgctttggaccaactgatgactagtcacttaggtttttgcagttttgctggggcatttcagaccttcataagcatgatctttggattagttttttttttttcttcacctcattattaggagttaatttatttttaaagtgtcatcttaaactgcaaggatgtcctttaaacatcacatgccaattaaacatgccgaaggagaagctgtgtcatcaaaatgcccacttaacctacccaaacatctcaaacctaccctttgctgaccttctatagccccatttccaaagttttgctttatttttattttttcttccaacttttattttaggtttaggggtacatgtgcaggtttgttacatgggtaaattgcattttgtgggagttctgcatacaaattatttaatcacccagataatgagcatagtacctgataggttgtttttctatcctcatctttctcccaccctccaccctcaagtaggccatggtgcctattgttcccttcttagagtccaagtgtactcaaagttcagctcccacttatgagtaagaacatttggtatttggttttctgttcctgcattaatttgcttacaataatggcctccagctacatccatgttgctggaaagacattattttgttcttttttatgactgtgtagtattatctggtatacatgtactacattttctttatccagtccactgtaatgggcatctaggttggttccatgtctttgctattgtcaatagtgctgtaatgaacataggcgtgcatggtctttatggtagaacaatttatattcctttgggtatataaccaataatgggattgctgggtcaaatggtatgtctgctttaagttctttgagaaatcttcaaactgctttccacagaggctgaactaatttatattcccatcagcagtgtatagcattcccttttctctgcagcctccccaacatctgttattttttgactttttaataacagccattctgactggtgtgagatggtatctcgttgtggttttgatttgcatttccctaatgattagtgatgttcagcattttttcatatgcttttggcccatggatgtcttcttttgagaagtgtctgttcatgtcctttcttccgtttttaatgggataattttttgcttgttaagttcttcatagattctggatatcagacctttgttcatgcatactttgaaaatattctctcccattctgtagattgtcagtttactctgttgatagtttctttggctgtgcagaagctatttagtttaattaggtcccacttgtcaatttttttttttttttagatggagtttccttctgtcacccaggctggagtgcagtggtgcaatctcggctcactgcaacctcctcctcctgggttcaagccattctcctgccccagcctctcaagtagctgggattacaagtggccaccaccacacctggctaatttttgtatttttattagagacggggtttcaccatgttggccaggctggtctcaaactcttgacctcaagtgatctacccacctcggcctcagaaagtgctaggattacaggcatgagccaccatgcccagccttcacttgtcaattattggctttgttccagttgcttttggagtctgtcatgatatctttgttaggtcttttgtccagaatgatatttcctaggttttcttctagggtttttatagttttaggttttacatttacattgttaacccatcttgagttgatttttgtatatggtaaaaagaaggggtccagtttcaatcctcaggatgtggctaaccagttatcccagcaccatttattaaatagggagtcctttccctgttgcttgttattgttgactttaacaaaaatcaagtagctgtaggtgtgtggcctttatttctgggttctctaacctgttccattggtctatgtgtctgtttttgtaccagtaccatgctgttttggttactatagccttgtagtttagtttgatgtcaggttgtgtgatgcctccctcattgctatatttgaattagttttaattgccaaggttgtttgacgctgagctagcagtagtgcctgggagtcggttaggtgaaacaaattgaggtcttttactaatattaaaattaaaacaccttgattttttttttgtgagctgtaaaaaactgaaagtcatgtaacttttgatttaactaacattttctgagtatctattatgtcagtatctcacactttaatccatattcccaccctgtgtggaggtattatcttcccttatttgcagattggaaacatacctgagtagtttactaacctaatcaaggtcaaacaaaatagcgtgtggttgagcttgattatgcttcttaaatcagtactgttttcatctacctaacatttgccttctgagaacaagtttttggatattaacttccatttaggccaggcacggtggctcacgcctgtaatcccaacactttggggaggccaagacgagtggatcacgaggtcaggagttcaagaccagcctggccaagatgctgaaaccctgtctctactaaaaataaaaaaattagctgggctacttgggaggctgaggctggagaatcgcttgaacccgggaggtggaggttgcagtgagccgagattgcccagcctaggtgacagagcgaggctccacctcaaaaaaaaaaaaaaactaaactaaaaattaaaatataacttccatttctaccaacttgatataacttgccattgatttaataggcatattggggcatgtcttgggagagacaagataccttttgattctgagaccaaaatataaagtaaaggggatcccttcaggaaatccccaaatcattttggagttttcccaaagtattttgggatttgtatcataataatatgtaaaatcattatagatcataggaggtgttttagatggtacctggcacaaatatcattgaaaaagcatagtgagaaacttgttctttttcaatatactttcagtcctcacatcaatcattctgtttaaggaaggagaaagctgattgatactatttacatatatcaacattggctgatttacctttttagccaactatgcaggcctcaggctcagaaacatcagcagtcaacaatataatatgtagctagaatgtaataggattgcattgttttattgaatttatcttcccttttatttatggtaatcaattctggcttcctgtttatgtgatggtattatgtttcctttaaaactaaatttaattttaaagaggtagaatcaatttaaaggtattaaataaataatagtatagacatagcagtaattatgataccaatacatgaaggattagagtatgggaaatatactggtacagttgagaatccctgaaatcagagatgggctctaccactgctttaatatgcgactttagtaacccactgattctgttgtagaattcttggacttgaagtactgttagttatcatttttcagtccaggatagtattgcatcaaacaaaattatgaaatatatacaaatttgagacattatgagcagaggcattgatgaccacatgctatatcttaaaattttactgatagttgattttagcaagtcttatgaaacactaagaacaatgtctggtgcctagcaaattctcagtaaatttcagctagtattattacagttagtattactttactatgctccctgataaaatttttataataaaatggttaatgactttccattgaggtctgatctgacttagttttagcataaagtaattacaattcatatttttagaggtttttttttttgtagtagtagaaacaactatttctaaatctggggattcagtagttcattcaaattaggatctttaagagctgtctaggtcaatgttccttaacgttttctacctgggagtaatctttaagagaacaaaaagaaaatgaaactctatataatttaatgcaaagtcttttacattaatgtaagggtaggaaaagaggttggaggaagatatggggaggtaggaaaatgggacttttttcctccatttacttttgatgtttgaatttcaaacatgagtatatttgtgtattattttgcggttaaaaacactgaagattgcataaagatcaaagagggaaatttaagggaattaatgggttatgattgcatttgttcagaatggttttggtggctcatgacaacattttgagagagagagattttaatggcaccaatggcagctaggataactagtttaaagtttagggcctgtgttaatagattttgctttctagtttcagaaagattctcttatagtactgttttaatctgtttttctaagccctctgatttatgtatatttaataggccacaaaataatgtcaaatatatggcataataaccaacaaatatttgaataagtgaaaggtactctacaaaatgctatgggaaagacaaaaataaataatatccctttctttgagggattaacagtgttaatatcccttgttttcatttgatttgaaatgccacttgcaagtggaatatgcagactaaatggtaaagagaaaaacaagcagcatcttttcatttcacttacagctcactgtatgaccaataatatgttacttgacctctcagcactccattctaaatccttaaatgatacttatttagcatttctaagcatcttgagatctcctcttaaaatatgctttgaactattcagtctaaatgctgctttctaaaaagctactagtttaaagaatgggaaatggtgttaatggagttaatcttgtgtaatttcagtgtgggttgtcaagaatacctctaagtaaagaaaatgactctaatcttcttaagcaattcattttctcagcaactttgaggcaggagttaatttactctgcctgtgtacataggccatctcttacaaaagaaaaattttactatggaaagaagtcagaatagccatgaaattatttaaatttagtctttagaacatattacaaaatataagatatattaaattgtcttttttgttagaaactcaactaccaatgtagaaataaaactcctgttgcaaggatggagtttagccatggagtcaaaacaagagctatttggttattttaaaagagaagagatcaaagagctggtcactccttaactaagggtgtttgggcagcaggatagggtgaagagtggagggggttgaactcaattctttatgcttttataccaagcctcccttttctaataagccttactggcatttccttagactagttaagtcaggattctgagtttttcagtacaatagggttttaatctgagctgatcattgtttccaatgcctcccctgtggcaggggaacataaaggactagtgttcttttctaaaaagggaagatggatattttttctataacctttataattccattataataaaatgaatgataggttataataaaatgaattttttgcatatgattttcaaaaggaaactaatttatttttctataaaatatcgcaaaggaatcgaatacatttttattctatgtaaataataatataattttcacatttaggaggcaatagcaaatctgggaagcagttattctaagttggaagagcattatcccaatgcattgaaaacatttgatgactattttttatgtcttctttattttgatgattataataatgttctaactgggtggccttcgtttttcactctagtcagtccatcttgtttactatgtcaattgttctccaaaaagtagaaatgtcattgttttggggccatagaacatttcagaagctttccagtatctatgcagtaacagtccaaacccctcaacataacacatttacacctgcaagtatggccccaaatcttcaagtggcttctgtcactactccatagtacataccctttgttacagctgtttcacaaatacaggttgaatatcccttatctaaaatgtttgggactaaaagtttcagatttcagatatgtttggattttggaatatttgtacatgtataatgagatactcttagagttgggacccaagtctaaacaaaattcatttatgtttcatatataccttatacacataacctgaaggtaatttatttttcccttgggaacactgaatagactatatgttgtgcacctacattttgactgtgacctatcacatgaagtcaggtgtggaattttccatttgtggcatcatgtcagtactcaaaaagttttggattttggattttgaattttcagattagagatgctcagcctaatagcaaatgttcccatgttatacacctcaacctcccattcccattggctggaacatctctgcttatattaaatgtcttttatgtgaaatctgtgttctcatagccttttgtatagttctctaccatctcatggctcacattgtattgtacttatttgattaaatatctggatcatctactgtgaattattcaagagcattgatctttatacctctggcacctatcagtgcctgacatataacagggttaaaaatgctgagtgaatactgcaaatataccttagcaaatttatttgctgaatacacatctcaagaaagttctgaaatagttatttcccctcatagaaagtttagagtattaaaattgggtatctttataatgctttttcttttgtaatactttcatctttgccttttattgaaatattaaatgcattgtagaatttgatttaaaatttagaacaagctgtcaggtatgataactagtctcatttaacaaatgaggattccagggcttgaagaagttaagtagcttcctctagattgtaaagagagtctaacctggccctttttggttttaagggcatgatgataaccacttgctctactgatttctaatggaaagtgcttcagttttccactttgcctagctagtgattatttaatatctgcttatctctgaatttatctgcatatttctaaaactttatgacattaaggaaagttggggaaaattcactttaagtgttgtaatgacaatagctatcaatcattgagtactgtgtactaagcattttatattttatcaacaagtacttacatgtgggataagtactgttattattttcattttatagatgaggacacatatagaatgcagttaggaaactagagaaagagaaaacatggagaattatctggaactaataagacagtaaagtacagatttaagaagttcagtgaatcccaagcagtgtaaattaaaaaactacattgagatacatcatagtgaatatgcaaaacatcaataataaaaagaaaaaccttaaaggcagctttaacagtatactgaatgaccaatatactcagcagccacagaacctctattcttttaaagcatccatgggacatttatagaaattgactatgcactggactataagcatatgcaataaaatttcaaatgactgaaaccatatgagtatattcttttgccacaacacaattaggctagaaatgaacaacaaaaagataacaggaaaatctctatatatcagaaattaagagatgcacttatttattttttgttttttgtgatggagtctcactctatcacccgtgcagtggcacgatcttggctcactgcaacctctgcctcttgggttcaagtgattctcctgtatcagcctcccaaggagctaggattacaggcgtgtgccaccatacccagctaatttttgtatttttattagagatgggatttcaccatgttggccatgctggtctcaaactcctgacctcaaatgatctgccagcctcagcctcccaaaatgctgggattacagatgaagagatacacttctaagtaatctatatgtcaagtaagacaaaatgaaattagaaaatatttttaagtcaatgatattaaaccatactacacatcaaaacttgtgggatgcacttaaagcagcatgtagagggagattatattcataaatgcttatggtagaaaagaaggaagtctgtacattatgtagctatgcacccatctaaagaagttaggaaaatgacatcaagtagaacatcaaaagaaagaaggaaaggataacttaaaacagaaatgaatgaaataaaaccagaatagaagagacgatctacaaatccaaaagttggtttgttgaaaatactagtagagctgacatacttgtggtgagactgatggaaataatgcagttacaactaaccaatatcataattggaaaggaaatcactataggtgctgtaaaaattaaaaagataatagaatattatgaacaattttctgccaatattattgaaagtttagataaaatggaaaattcatttaaaaatataatttgacagtattatgttatgtgaatactataatgataatcctgtaatcattaaatgaaccagtagtttaaaatttttccatatagggaaggtcagggccagatgtgttcaatggttggttctactagacattcaaaaaaataataattcaagtctacacaaactttcctgagattagaaaaaataaagaagagtccccccacctgtttcttactttatgagaccacacctaaaagatagaagactgctttgcaaccaagaaatccttcatgaacacctctttaatcacaagtcctcaactccaaggttagctttatttcaacttttataatacttttcttacttttcttgatagctttaccacccatgtattcattcctaaaaaatacacagttttgtctgattttgaattttatgtgaatggaattgtacatatctgtgtttgtgtcttccttgttttactcaatactgtttctgagatcaatcacattatttgttaatattttgtttaggatttttgcatctctatttcagtgtgtgtttggaatgtaaatttccattctcagactatcttttggcctgaatttggttacatgagtatatgttctaaaaatattacttacactttcaataaattttaaggacttttatattgttatgtatcaaattttttagaatgcaagaataaatattataaaacat

SEQ ID NO: 172323 - DNA, 1873 bp, Homo sapiens
  Payload ID: 13879
  Gene Symbol: PUS7L
  Gene Name: pseudouridylate synthase 7-like
  Uniprot ID: Q9H0K6
  ENST ID: ENST00000431332
  CDS Start-End: 94-1260
aacacttaaggcttccgggcatgcgcacagcgttgtgcaaatgaatgccttccactgaaccgagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttggatgatcctgtaaatagagcaaagaagtattttcttcaaactgaggatgctaaaggcacactttcattgatgcctgaattcaaagtgcgtgagagagcattgttggaggcattgcaccgctttggcatgaccgaggaaggttgtatccaggcatggttctctttaccccattccatgcgcatattctatgttcacgcatataccagcaaaatttggaatgaggcagtatcttacagacttgaaacctatggagcaagagtagtgcagggtgatttggtctgtttggatgaagacattgatgacgagaatttcccaaatagtaaaattcacctggtaactgaagaggagggatcagctaatatgtatgcaatacatcaggtggttcttccagtacttggatacaatattcagtacccgaagaacaaagtagggcagtggtaccatgacatacttagcagagatggactacagacatgtaggtttaaagtacctactctgaaactgaatataccaggttgctatagacagattttgaaacatccctgtaatctctcataccaactaatggaagatcatgacattgatgtcaaaacgaaaggttcccacattgatgaaacagctttgtctcttttgatctcttttgatcttgatgcttcatgctatgctaccgtttgtctgaaggaaataatgaagcatgacgtttaaaactgatacccttggtataaccatatatatgtcactctttgaaggaaagggggctaaaatgtcttaagcaccttccatgtgttaggaacttcataattgttatctcttttaattttcacagcatcctgagaagttaggatttgatactgtaattttatagaggatatgtaagtgtcagggtccaaatttaaggtccatgtgaccccaaagcctgtgttttttttctattatatgtttcagtgacctttattctgtgtcataaagttacaatcttttaaaaccattaggaatatatataatactgcaagataacatttaagaaaaaaagttgtgaatattcatatcctccagctccttgcttagaacactagtaaaattaggtcgcagtgaagcaaatgttggagagaaagatagatgaagcattttgctaattattattgtccccctttcctgtttttgaaattattgatcagaacaatatacaagggaaatgccatacctctgtttgtgatagataccccagagtagttattacctctttgtgagataagtaatctttgatgaagattgaaatacaatttctcatccaatttttatatcttggcatacgctg

SEQ ID NO: 172324 - DNA, 4364 bp, Homo sapiens
  Payload ID: 13879
  Gene Symbol: PUS7L
  Gene Name: pseudouridylate synthase 7-like
  Uniprot ID: Q9H0K6
  ENST ID: ENST00000416848
  CDS Start-End: 490-2595
tgcaaatgaatgccttccactgaaccgaggtagacggggtcgagtttcttgcgcgatggtgggcttgtatgtgtgtgtgtgtgtgtgtgtgtggggggggggggtgacgaggttggcattgaggatccataccctttgcgcccaaagaaaggtgacgtggactagtgtcgtgcctttggacaggcagagtaagaggagggagaagaaacaggtagagctgctggccttgtcggggacacctttggacgtgctggagggcaacgacgccctagttttctgtgaagttaagtagcttctgcaggactgggttcagtatttctagtaccttctcaggatccctcctccgccaacgaattcctcaaccacgggccaagcaaactactcccccgcccactgtcagcagcagtctctgttgaatgggaatactgcaccttcaggcttaacgccacgtgggctcctttgctgtcctccaggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggctttctaaaacagagctaattggactacctcctgaattctcaataggcagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttggatgatcctgtaaatagagcaaagaagtattttcttcaaactgaggatgctaaaggcacactttcattgatgcctgaattcaaagtgcgtgagagagcattgttggaggcattgcaccgctttggcatgaccgaggaaggttgtatccaggcatggttctctttaccccattccatgcgcatattctatgttcacgcatataccagcaaaatttggaatgaggcagtatcttacagacttgaaacctatggagcaagagtagtgcagggtgatttggtctgtttggatgaagacattgatgacgagaatttcccaaatagtaaaattcacctggtaactgaagaggagggatcagctaatatgtatgcaatacatcaggtggttcttccagtacttggatacaatattcagtacccgaagaacaaagtagggcagtggtaccatgacatacttagcagagatggactacagacatgtaggtttaaagtacctactctgaaactgaatataccaggttgctatagacagattttgaaacatccctgtaatctctcataccaactaatggaagatcatgacattgatgtcaaaacgaaaggttcccacattgatgaaacagctttgtctcttttgatctcttttgatcttgatgcttcatgctatgctaccgtttgtctgaaggaaataatgaagcatgacgtttaaaactgatacccttggtataaccatatatatgtcactctttgaaggaaagggggctaaaatgtcttaagcaccttccatgtgttaggaacttcataattgttatctcttttaattttcacagcatcctgagaagttaggatttgatactgtaattttatagaggatatgtaagtgtcagggtccaaatttaaggtccatgtgaccccaaagcctgtgttttttttctattatatgtttcagtgacctttattctgtgtcataaagttacaatcttttaaaaccattaggaatatatataatactgcaagataacatttaagaaaaaaagttgtgaatattcatatcctccagctccttgcttagaacactagtaaaattaggtcgcagtgaagcaaatgttggagagaaagatagatgaagcattttgctaattattattgtccccctttcctgtttttgaaattattgatcagaacaatatacaagggaaatgccatacctctgtttgtgatagataccccagagtagttattacctctttgtgagataagtaatctttgatgaagattgaaatacaatttctcatccaatttttatatcttggcatacgctgaccctcttgaccatttgtaattttttcatattatctaaaacaggtgttagagtcagacagattcattcttagattctagctctgacacttactagtgattttgagtatgttgttgatttttttgtgtgtggttactgatagaatcaagacaattacaacttcataaatgacaaataataggattatctccacattttctgttgctggaggaacaaaacattgtgcccatttgaaaattttaatttttgttggtttaactatcccacattataaatcatccttcaccattttatatcagttaaatatgggtgtgttggggaggaatgactggcatgtagacatgtattgatttaggaagatctgagcatttctttcattgttggtaagatataatgatgaaatttaaaaagcagtatggagcattatatatcagtaatgtgatatatatacttaagccagtttaaccattttgggaaatgttagcattaggaaataaaatccaaaagaaggaagagaagctatatgcaatgcaaaatttgcttattgcaatattttcatatacagacactaaaaacagttttcaaagtccagcattacgtaactaaagtaagtaaaatgatgtgtatcaacttgatggtaaaatatgtagttatttaaaaaagcaatgaacaatttagtttcatgagaaaatgttgccccctaaaagtagaacacatatgttacaactgcaataatactctgaattcatctttcacaaataagagacatgttagcatagtgattaaaagcacagatattggagacaaactaacccagtttgaaccctggcactgccacgtatagcactgcagccttgggaaagttatttaaactcatgggcttcagtttcaacatctgtaaaatgggcatgttaacattgcctacctcataggattactgtgagaattttctaagttaatatatgtaaagcaactttaaaaagtgcctggcacttagttattgttaagtaagtgtctgcagatgcaagtttggaagagaaaagcaaataaatgaaaatcccttcctgttaagatgatggggtatttggattttttttaatactaaaaagttttttttgttatatgttttggcaataaataattctcaatacacaaaa

SEQ ID NO: 172325 - DNA, 1149 bp, Homo sapiens
  Payload ID: 13879
  Gene Symbol: PUS7L
  Gene Name: pseudouridylate synthase 7-like
  ENST ID: ENST00000553166
  CDS Start-End: 55-1149
acagcgttgtgcaaatgaatgccttccactgaaccgaggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggctttctaaaacagagctaattggactacctcctgaattctcaataggcagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaatt

SEQ ID NO: 172326 - DNA, 3313 bp, Homo sapiens
  Payload ID: 13879
  Gene Symbol: PUS7L
  Gene Name: pseudouridylate synthase 7-like
  Uniprot ID: Q9H0K6
  ENST ID: ENST00000551923
  CDS Start-End: 90-2195
atgcgcacagcgttgtgcaaatgaatgccttccactgaaccgaggtagacggggtcgagtttcttgcgcgatggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagctcctttttggatgaaaaaactcatgagttactgaataattttgcctgtgatgtaagagagaagtggctttctaaaacagagctaattggactacctcctgaattctcaataggcagaatccttgacaaaaaccagagggctagtttacacagtgccattaggcagaaatttccatttttagtaactgtaggaaaaaacagtgaaattgttgtaaaaccaaatcttgaatataaagaactttgtcatttggtatctgaagaggaagcatttgacttttttaaatatttggatgcaaagaaagaaaattccaaatttacctttaaacctgatacaaacaaagaccacagaaaagctgtccaccattttgtcaacaaaaagtttggaaaccttgtggaaaccaaatctttttctaaaatgaattgcagtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttggatgatcctgtaaatagagcaaagaagtattttcttcaaactgaggatgctaaaggcacactttcattgatgcctgaattcaaagtgcgtgagagagcattgttggaggcattgcaccgctttggcatgaccgaggaaggttgtatccaggcatggttctctttaccccattccatgcgcatattctatgttcacgcatataccagcaaaatttggaatgaggcagtatcttacagacttgaaacctatggagcaagagtagtgcagggtgatttggtctgtttggatgaagacattgatgacgagaatttcccaaatagtaaaattcacctggtaactgaagaggagggatcagctaatatgtatgcaatacatcaggtggttcttccagtacttggatacaatattcagtacccgaagaacaaagtagggcagtggtaccatgacatacttagcagagatggactacagacatgtaggtttaaagtacctactctgaaactgaatataccaggttgctatagacagattttgaaacatccctgtaatctctcataccaactaatggaagatcatgacattgatgtcaaaacgaaaggttcccacattgatgaaacagctttgtctcttttgatctcttttgatcttgatgcttcatgctatgctaccgtttgtctgaaggaaataatgaagcatgacgtttaaaactgatacccttggtataaccatatatatgtcactctttgaaggaaagggggctaaaatgtcttaagcaccttccatgtgttaggaacttcataattgttatctcttttaattttcacagcatcctgagaagttaggatttgatactgtaattttatagaggatatgtaagtgtcagggtccaaatttaaggtccatgtgaccccaaagcctgtgttttttttctattatatgtttcagtgacctttattctgtgtcataaagttacaatcttttaaaaccattaggaatatatataatactgcaagataacatttaagaaaaaaagttgtgaatattcatatcctccagctccttgcttagaacactagtaaaattaggtcgcagtgaagcaaatgttggagagaaagatagatgaagcattttgctaattattattgtccccctttcctgtttttgaaattattgatcagaacaatatacaagggaaatgccatacctctgtttgtgatagataccccagagtagttattacctctttgtgagataagtaatctttgatgaagattgaaatacaatttctcatccaatttttatatcttggcatacgctgaccctcttgaccatttgtaattttttcatattatctaaaacaggtgttagagtcagacagattcattcttagattctagctctgacacttactagtgattttgagtatgttgttgatttttttgtgtgtggttactgatagaatcaagacaattacaacttcataaatgacaaataataggattatctccacattttctgttgctggaggaacaaaacattgtgcccatttgaaaattttaatttttgttggtttaactatcccacattataaatcatccttcaccattttatatcagttaaatatgggtgtgttggggaggaatgactggcatgtagacatgtattgatttaggaagatctgagcatttctttcattgttggtaagatataatgatgaaatttaaaaagcagtatggagcattatatatcagtaatgtgatatatatacttaagccagtttaaccattttgggaaatgttagcattaggaaataaaatccaaaa

SEQ ID NO: 172327 - DNA, 677 bp, Homo sapiens
  Payload ID: 13879
  Gene Symbol: PUS7L
  Gene Name: pseudouridylate synthase 7-like
  ENST ID: ENST00000550784
  CDS Start-End: 196-677
gtgcaaatgaatgccttccactgaaccgaggtagacggggtcgagtttcttgcgcgatgtgctggtaatccgaatgtggtggtaacagtaagatttcgggaaaaagcacacaaacgtgggaaaaggcctctttctgaatgccaagaaggaaaagttatatatacagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttggatgatcctgtaaatagagc

SEQ ID NO: 172328 - DNA, 784 bp, Homo sapiens
  Payload ID: 13879
  Gene Symbol: PUS7L
  Gene Name: pseudouridylate synthase 7-like
  ENST ID: ENST00000549868
  CDS Start-End: 406-784
gtgcaaatgaatgccttccactgaaccgaggtagacggggtcgagtttcttgcgcgatggtgggcttgtgacgtggactagtgtcgtgcctttggacaggcagagtaagaggagggagaagaaacaggtagagctgctggccttgtcggggacacctttggacgtgctggagggcaacgacgccctagttttctgtgaagttaagtagcttctgcaggactgggttcagtatttctagtaccttctcaggatccctcctccgccaacgaattcctcaaccacgggccaagcaaactactcccccgcccactgtcagcagcagtctctgttgaatgggaatactgcaccttcaggcttaacgccacgtgggctcctttgctgtcctccaggcactgttatagaagaatggaagaagatacagattatagaatcaggtttagttctttgtgtttctttaatgatcacgttggatttcatggcactataaaaagctcaccaagtgactttattgttattgaaattgatgaacagggacagttagttaataagaccatcgatgagcctattttcaagattagtgaaatacaacttgagccaaataattttcccaaaaaaccaaaactagatcttcaaaatctgtccttagaagatggaagaaaccaagaagttcatactttgattaagtacactgatggtgaccaaaatcatcagtctggttcagaaaaggaagatactatcgttgatggaacttccaaatgtgaagaaaaagctgatgttttaagct

SEQ ID NO: 172329 - DNA, 566 bp, Homo sapiens
  Payload ID: 13879
  Gene Symbol: PUS7L
  Gene Name: pseudouridylate synthase 7-like
  ENST ID: ENST00000547156
  CDS Start-End: 105-566
gtgcaaatgaatgccttccactgaaccgaggcactgttatagaagaatggaagaagatacagattatagaatcagcttttaccctacgaaaggaaaacctggaaatgtttgaagcgattggttttttagctatcaaacttggtgttattccttcggattttagttatgcaggccttaaagacaagaaagccatcacctatcaagcaatggttgttagaaaagtgactccagagaggttgaaaaatattgaaaaagaaattgaaaagaaaagaatgaatgtctttaatattcggtctgtagatgattccctgagacttggtcagctcaaaggaaatcactttgatattgtcattagaaatttaaaaaaacaaataaatgattctgcaaacctgagggagagaattatggaagcaatagaaaatgttaagaaaaaaggctttgtgaattactatggaccacagagatttgggaagggaaggaaagttcacacagaccaaattggactagctttgctgaagaatgaaatgatgaaagccataaaattgtttcttacaccagaagacttg

SEQ ID NO: 172330 - DNA, 1287 bp, Homo sapiens
  Payload ID: 13880
  Gene Symbol: PUSL1
  Gene Name: pseudouridylate synthase-like 1
  Uniprot ID: Q8N0Z8
  ENST ID: ENST00000379031
  CDS Start-End: 78-989
gtgaccaggccgcgtccgcgcgcgcgcaggattcctgcgctggaggccgcctctgacgccaccggctgggctccgccatgagttcggcgccggcctcaggctccgtgcgcgcgcgctatcttgtgtacttccagtacgtgggcaccgactttaacggggtcgcggccgtcaggggcactcagcgcgccgtcggggtccagaactacctggaggaggccgccgagcggctgaattccgtggagccggtcaggttcaccatctccagccgcacggacgccggggtccacgccctgagcaacgcggcgcacctggacgtccagcgccgctcaggccggccgcccttcccgcccgaggtcctggccgaggccctcaacacacacctgcggcacccggccatcagggtcctgcgggccttccgagtgcccagcgacttccacgctcgtcacgcagccacgtcccggacctacctgtaccgcctggccactggctgtcaccggcgtgatgagctgccggtgtttgaacgcaacctatgctggactctcccggcagactgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggaagctgcggttctggaacctggagtttgagagccagtctttcctgtatagacaggtacggaggatgacggctgtgctggtggccgtggggctgggggctttggcacctgcccaggtgaagacgattctggagagccaagatcccctgggcaagcaccagacacgtgtagccccagcccacggcttattcctcaagtcagtgctgtacgggaacctcggtgctgcctcctgcaccctgcaggggccacagttcgggagccacggatgaccctggacactcaagccaaagttaggccacaccaggcccaaccctgtgctggtcaagccagggcagtcacagctgcttggggcccacagcactgctgcctggtctccacagtagcctccctgcccgggtcccagcaccctggatgcccgtctctgtcccaggcgggatggggcacagtgcaggacacagccatgtacaccaagaagagagtaccaagtagtcttttgttcagcttttactggaaactgctgtctaggaccacctgccctaaccaggaataaaggcaagacagcctgga

SEQ ID NO: 172331 - DNA, 877 bp, Homo sapiens
  Payload ID: 13880
  Gene Symbol: PUSL1
  Gene Name: pseudouridylate synthase-like 1
  ENST ID: ENST00000467712
  CDS Start-End: 501-877
aacgttcggggaaggaagcggccctggcctcagacggcggcggagaccccagggcagggcgcccccggtaacctccgcccgcttctgcccgcagcggggtcgcggccgtcaggggcactcagcgcgccgtcggggtccagaactacctggaggaggccgccgagcggctgaattccgtggagccggtcaggttcaccatctccagccgcacggacgccggggtccacgccctgagcaacgcggcgcacctggacgtccagcgccgctcaggccggccgcccttcccgcccgaggtcctggccgaggccctcaacacacacctgcggcacccggccatcagggtcctgcgggccttccgagtgcccagcgacttccacgctcgtcacgcagccacgtcccggacctacctgtaccgcctggccactggctgtcaccggcgtgatgagctgccggtgtttgaacgcaacctatgctggactctcccggcagactgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggaagctgcggttctggaacctggagtttgagagccagtctttcctgtatagacaggtacggaggatgacggctgtgctggtggccgtggggctgggggctttggcacctgcccaggtgaagacgattctggagagccaagatcccctgggcaagcaccagacacgtgtagccccagcccacggcttattcctcaagtcagtgctgtacgggaacct

SEQ ID NO: 172332 - DNA, 1408 bp, Homo sapiens
  Payload ID: 13881
  Gene Symbol: PSMC3IP
  Gene Name: PSMC3 interacting protein
  Uniprot ID: Q9P2W1
  ENST ID: ENST00000253789
  CDS Start-End: 146-763
ggagtccgggaggggtcgctttgctcctccggaaggcttccccttcagccaatcaccgttcgaggcccgcccccgtcgccggaaggagccgtcgccccgagcaactacaacgtccggctttctgagttgggtggcgggaaaggcgatgagtaaaggccgggcagaagctgcggcgggagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggaccagtttgacatggtgagtgatgctgaccttcaagtcctagatggcaaaatcgtggccctcactgctaaggtgcagagcttgcagcagagctgccgctacatggaggctgagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagacccagcccatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaa

SEQ ID NO: 172333 - DNA, 1416 bp, Homo sapiens
  Payload ID: 13881
  Gene Symbol: PSMC3IP
  Gene Name: PSMC3 interacting protein
  Uniprot ID: Q9P2W1
  ENST ID: ENST00000393795
  CDS Start-End: 110-763
cttccccttcagccaatcaccgttcgaggcccgcccccgtcgccggaaggagccgtcgccccgagcaactacaacgtccggctttctgagttgggtggcgggaaaggcgatgagtaaaggccgggcagaagctgcggcgggagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggaccagtttgacatggtgagtgatgctgaccttcaagtcctagatggcaaaatcgtggccctcactgctaaggtgcagagcttgcagcagagctgccgctacatggaggctgagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagacccagcccatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattggtatttagaaaaataaaaaatttccaat

SEQ ID NO: 172334 - DNA, 902 bp, Homo sapiens
  Payload ID: 13881
  Gene Symbol: PSMC3IP
  Gene Name: PSMC3 interacting protein
  ENST ID: ENST00000588544
  CDS Start-End: 110-367
cttccccttcagccaatcaccgttcgaggcccgcccccgtcgccggaaggagccgtcgccccgagcaactacaacgtccggctttctgagttgggtggcgggaaaggcgatgagtaaaggccgggcagaagctgcggcgggagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggtgaggagaacttgcgccgattgtcacccatgagagcccgacaacgggtgaatctactcctggtgtgaactctttggggacaaggccccccatggaaaactcacctgtcttaggccaccatccttaaatcaaggaccagtttgacatggtgagtgatgctgaccttcaagtcctagatggcaaaatcgtggccctcactgctaaggtgcagagcttgcagcagagctgccgctacatggaggctgagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcc

SEQ ID NO: 172335 - DNA, 747 bp, Homo sapiens
  Payload ID: 13881
  Gene Symbol: PSMC3IP
  Gene Name: PSMC3 interacting protein
  ENST ID: ENST00000586337
  CDS Start-End: 3-257
cgatgagtaaaggccgggcagaagctgcggcgggagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcagaccctctggagactttggggaccagtttgacatggtgagtgatgctgaccttcaagtcctagatggcaaaatcgtggccctcactgctaaggtgcagagcttgcagcagagctgccgctacatggaggctgagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttg

SEQ ID NO: 172336 - DNA, 664 bp, Homo sapiens
  Payload ID: 13881
  Gene Symbol: PSMC3IP
  Gene Name: PSMC3 interacting protein
  Uniprot ID: Q9P2W1
  ENST ID: ENST00000590760
  CDS Start-End: 380-658
gggaaaggcgatgagtaaaggccgggcagaagctgcggcgggaggtaacggcgccgtgggcgcggggaagacccgggagggcagtgggtgaggaggtcggttgagtggccccctcccctgcctttctctccgtagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggaccagtttgacatgagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcc

SEQ ID NO: 172337 - DNA, 1049 bp, Homo sapiens
  Payload ID: 13881
  Gene Symbol: PSMC3IP
  Gene Name: PSMC3 interacting protein
  ENST ID: ENST00000590931
  CDS Start-End: 110-460
cttccccttcagccaatcaccgttcgaggcccgcccccgtcgccggaaggagccgtcgccccgagcaactacaacgtccggctttctgagttgggtggcgggaaaggcgatgagtaaaggccgggcagaagctgcggcgggagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggaccagtttgacatggtgagtgatgctgaccttcaagtcctagatggcaaaatcgtggccctcactgctaaggtgcagagcttgcagcagagctgccgctacatggaggctggtaggactgggtagcccctccaaagtgcccataggcttaggttcattctagaggtcaggaattactaaatgaatggttcaatgactgcagcatcttgttgcagctaagacccctttgctgggctcccttaggcataaaaagaaatgtaggataactaacggcttttgtgtaccaacaaatggacaagatacgcatttgttctccctgccacgattatcagtacactgtccccacgtttccctttattcctgcttctttaactggctacgcctaagtaagtagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcc

SEQ ID NO: 172338 - DNA, 1381 bp, Homo sapiens
  Payload ID: 13881
  Gene Symbol: PSMC3IP
  Gene Name: PSMC3 interacting protein
  ENST ID: ENST00000587209
  CDS Start-End: 292-756
cgggaaaggcgatgagtaaaggccgggcagaagctgcggcgggaggtaacggcgccgtgggcgcggggaagacccgggagggcagtgggtgaggaggtcggttgagtggccccctcccctgcctttctctccgtagccgccgggatcctcctgaggtacctgcaggagcagaaccggccctacagctcccaggatgtgttcgggaacctacagcgggaacacggactgggcaaggcggtggtggtgaagacgctggagcagctggcgcaacaaggcaagatcaaagagaagatgtacggcaagcagaagatctattttgcggatcaggaccagtttgacatggtgagtgatgctgaccttcaagtcctagatggcaaaatcgtggccctcactgctaaggtgcagagcttgcagcagagctgccgctacatggaggctgagctcaaggaattatctagtgccctgaccacaccagagatgcagaaagaaatccaggagttaaagaaggaatgcgctggctacagagagagattgaagaacattaaagcagctaccaatcatgtgactccagaagagaaagagcaggtgtacagagagaggcagaagtactgtaaggagtggaggaagaggaagaggatggctacagagctgtctgatgcaatacttgaaggataccccaagagcaagaagcagttctttgaggaagttgggatagagacggatgaagattacaacgtcacactcccagacccctgaggggcccacggtcaggactggtggggactgcaggatgtcagaagagtgagatgtcttgcactggctaccttgtttttggttggcttttgttgttgttcctgctactttcacctttaagcagagcagtcaggagacaagcataaaccagagcactgggtagagaggatgagggctggtggctgggggtagacccagcccatttcattgtctaaattgcagtagcttgaggttaacatttagacttggaacaatgctaaaggaaagcatttggcaatatttattataatttaattttatataaaaatatttaatttcctctggatagtcaaacctgccagatatcaaacctgaggaaggcagaagtgaatttggagaactagggtagagagaggttgctataaaacgagcatttggagggcccacggcttcactcaggacctgctgggcttgtgtaccccaggagcccttttaagtatcttttgtacgcttttcaccccacccccaagtcctgggagaaatgcaggcaacactgagacatgggagaggccaagatatgcttgacagaaagggtgattttgaggctcagttaatatttcaaaattgtaaccgtagcaaaactgcattg

SEQ ID NO: 172339 - DNA, 908 bp, Homo sapiens
  Payload ID: 13882
  Gene Symbol: PSORS1C1
  Gene Name: psoriasis susceptibility 1 candidate 1
  Uniprot ID: Q9UIG5
  ENST ID: ENST00000259881
  CDS Start-End: 290-748
ggtgtcccagaaacccaggaaatcgagactcatgactcccagagaggatggcatctagaagtagacgatcaagggtggaatctacagtccgtgagccctgacttcttgccttcgtctcaaatagactctgcagccagccatctatgcagcgccccagtggctttgaaatgcaacagaaaccatcacccccggaccgtgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggaccccagctccttaacacagatcccagctccgaggaaactcgtcccccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaacgtttccctcaaggacctttctgcctggaagtctgttagcctttcagaagtaacatgtccaaaataaaatttgattcctcccaggttgttccctgcctggtccgctaccccacagtaaggaacaccttattatgcaa

SEQ ID NO: 172340 - DNA, 852 bp, Homo sapiens
  Payload ID: 13882
  Gene Symbol: PSORS1C1
  Gene Name: psoriasis susceptibility 1 candidate 1
  ENST ID: ENST00000376289
  CDS Start-End: 290-481
ggtgtcccagaaacccaggaaatcgagactcatgactcccagagaggatggcatctagaagtagacgatcaagggtggaatctacagtccatgggccctgacttcttgccttcgtctcaaatagactctgcagccagccatctatgcagcgccccagtggctttgaaatgcaacagaaaccatcacccctggaccatgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggaccccagctccttaacacagatcccagctccgaggaaactcatccccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctctaactctattgtactcgtctcctccctcccattctccttttggtctcagctccttgatctaagcctcccagagagaccctagaacgtttccctcaaggacctttctgcctggaagtctgttagcctttcagaagtaacatgtccaaaataaaatttgattcctccca

SEQ ID NO: 172341 - DNA, 854 bp, Homo sapiens
  Payload ID: 13882
  Gene Symbol: PSORS1C1
  Gene Name: psoriasis susceptibility 1 candidate 1
  Uniprot ID: Q9UIG5
  ENST ID: ENST00000448455
  CDS Start-End: 290-748
ggtgtcccagaaacccaggaaatcgagactcatgactcccagagaggatggcatctagaagtagacgatcaagggtggaatctacagtccgtgggccctgacttcttgccttcgtctcaaatagactctgcagccagccatctatgcagcgccccagtggctttgaaatgcaacagaaaccatcacccccggaccgtgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggaccccagctccttaacacagatcccagctccgaggaaactcgtcccccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaacgtttccctcaaggacctttctgcctggaagtctgttagcctttcagaagtaacatgtccaaaataaaatttgattcctccca

SEQ ID NO: 172342 - DNA, 854 bp, Homo sapiens
  Payload ID: 13882
  Gene Symbol: PSORS1C1
  Gene Name: psoriasis susceptibility 1 candidate 1
  Uniprot ID: Q9UIG5
  ENST ID: ENST00000433334
  CDS Start-End: 290-748
ggtgtcccagaaacccaggaaatcgagactcatgactcccagagaggatggcatctagaagtagacgatcaagggtggaatctacagtccatgggccctgacttcttgccttcgtctcaaatagactctgcagccagccatctatgcagcgccccagtggctttgaaatgcaacagaaaccatcacccccggaccgtgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggaccccagctccttaacacagatcccagctccaaggaaactcgtcccccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaatgtttccctcaaggacctttctgcctggaagtctgttagcctttcagaagtaacatgtccaaaataaaatttgattcctccca

SEQ ID NO: 172343 - DNA, 854 bp, Homo sapiens
  Payload ID: 13882
  Gene Symbol: PSORS1C1
  Gene Name: psoriasis susceptibility 1 candidate 1
  Uniprot ID: Q9UIG5
  ENST ID: ENST00000420214
  CDS Start-End: 290-748
ggtgtcccagaaacccaggaaatcgagactcatgactcccagagaggatggcatctagaagtagacgatcaagggtggaatctacagtccatgggccctgacttcttgccttcgtctcaaatagactctgcagccagccatctatgcagcgccccagtggctttgaaatgcaacagaaaccatcacccccggaccatgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggaccccagctccttaacacagatcccagctccgaggaaactcgtcccccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaacgtttccctcaaggacctttctgcctggaagtctgttagcctttcagaagtaacatgtccaaaataaaatttgattcctccca

SEQ ID NO: 172344 - DNA, 854 bp, Homo sapiens
  Payload ID: 13882
  Gene Symbol: PSORS1C1
  Gene Name: psoriasis susceptibility 1 candidate 1
  Uniprot ID: Q9UIG5
  ENST ID: ENST00000441092
  CDS Start-End: 290-748
ggtgtcccagaaacccaggaaatcgagactcatgactcccagagaggatggcatctagaagtagacgatcaagggtggaatctacagtccatgggccctgacttcttgccttcgtctcaaatagactctgcagccagccatctatgcagcgccccagtggctttgaaatgcaacagaaaccatcacccccggaccgtgggctccatgccagtgggcaaagcacagcctgggaagaattggtttgcagccaggcagtcctccatccagtcttgactttggcacttgtgatatgacttgcacagaccaaaaaagtcactctcaaagagctctcggcacacagaccccagctttacaaggaccccagctccttaacacagatcccagctccgaggaaactcgtcccccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaatgtttccctcaaggacctttctgcctggaagtctgttagcctttcagaagtaacatgtccaaaataaaatttgattcctccca

SEQ ID NO: 172345 - DNA, 501 bp, Homo sapiens
  Payload ID: 13882
  Gene Symbol: PSORS1C1
  Gene Name: psoriasis susceptibility 1 candidate 1
  ENST ID: ENST00000481450
  CDS Start-End: 126-395
agccccacccagccccagccccaggaggaggagcctgtctggatggacgcagcctgaactgacccacaaacagaccaaaaaagtcactctcaaagagctctcggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaacgtttccctcaaggacctttctgcctggaagtctgttagcctttcagaagtaacatgtccaaaataaaatttgattcctccca

SEQ ID NO: 172346 - DNA, 655 bp, Homo sapiens
  Payload ID: 13882
  Gene Symbol: PSORS1C1
  Gene Name: psoriasis susceptibility 1 candidate 1
  ENST ID: ENST00000547221
  CDS Start-End: 236-550
agcgatcgcgcgggcaggaagaccgggtgggagccccacccagccccagccccaggaggaggagcctgtctggatggacgcagcctgaactgacccacaaacagaccaaaaaagtcactctcaaagagctctcggcacacagaccccagctttacaaggaccccagctccttaacacagatcccagctccgaggaaactcgtcccccccacgttaatcctgaccgactttgccacatggagccagcaaaccatttctggcatgcaggggacctccaagcaatgatatccaaggaattccatctggcagccacccaggatgactgcagaaaaggaaggacacaggaggatatcctggttccctcttcccacccagagctgtttgcatcagtcctgccaatggctccggaagaagctgccaggctccagcaacctcagccccttcctcctccctcaggaatccacctatccgcctctaggaccttggctccaactctattgtactcgtctcctccctcccattctccttttggtctcagctccttgatctaagcctcccagagagacccctagaacgtttccctcaaggacctttctgcctggaagtctgttagcctttcagaagtaacatgtccaaaataaaatttgattcctccc

SEQ ID NO: 172347 - DNA, 1150 bp, Homo sapiens
  Payload ID: 13883
  Gene Symbol: PSORS1C2
  Gene Name: psoriasis susceptibility 1 candidate 2
  Uniprot ID: Q9UIG4
  ENST ID: ENST00000259845
  CDS Start-End: 325-735
gtgattacggagatgccaagtgggtattgactgctccaggatgtggatggagggtgtgaaaaccagggtggggtgacgcaggctctgggtcatgatagggagagcaggcagctgggtcctgggctggaggactaaaataagggacgccaccttcaggggtgacacatcagcccaggccttcccaacgggtttgaccagttctgttctgatggtattcctgtgccactgggctggtccctcctccactcctcccctataaagcctcttggggttcccaggcacccagactcagcccaccccagctttgggggccagtacatagccatgatcctcaactggaagctcctggggatcctggtcctttgcctgcacaccagaggcatctcaggcagcgagggccacccctctcacccacccgcagaggaccgagaggaggcaggctccccaacattgcctcagggccccccagtccccggtgacccttggccaggggcaccccctctctttgaagatcctccgcctacccgccccagtcgtccctggagagacctgcctgaaactggagtctggctccctgaaccgcctagaacggatcctcctcaacctccccggcctgacgacccttggccggcaggaccccagcccccagaaaacccctggcctcctgcccctgaggtggacaaccgacctcaggaggagccagacctagacccaccccgggaagagtacagataatggagtcccctcagccgttctgttcccaggcatctccaggcacccacgccctctccaccctctgattccccgtgaattcttcccaatttagcctgtctccttaaacctcttcctcattccctcggttttattctgaacccgtaaggtggtgttctcaatatttcctgtcccctcctgagatccatacttagtcctcacatcgcccgttttttcctctgacagcctaagcctactctcctacctcgcctccaggcctcggccgcacctacctcccacccggtcttcctgcccgcgcgatcgctggggcagggctatggtactgtgttcccttctgccacctggtggccggcggcaggaactatcagtagacagctgctgcttccatgaaacggaaaaataaaaatcatgttttctt

SEQ ID NO: 172348 - DNA, 1151 bp, Homo sapiens
  Payload ID: 13883
  Gene Symbol: PSORS1C2
  Gene Name: psoriasis susceptibility 1 candidate 2
  Uniprot ID: Q9UIG4
  ENST ID: ENST00000383530
  CDS Start-End: 325-735
gtgattacggagatgccaagtgggtattgactgctccagggtgtggatggagggtgtgaaaaccagggtggggtgacgcaggctctgggtcatgatagggagagcaggcagctgggtcctgggctggaggactaaaataagggacgccaccttcaggggtgacacatcagcccaggccttcccaacgggtttgaccagttctgttctgatggtattcctgtgccactgggctggcccctcctccactcctcccctataaagcctcttggggttcccaggcacccagactcagcccaccccagctttgggggccagtacatagccatgatcctcaactggaagctcctggggatcctggtcctttgcctgcacaccagaggcatctcaggcagcgagggccacccctctcacccacccgcagaggaccgagaggaggcaggctccccaacattgcctcagggccccccagtccccggtgacccttggccaggggcaccccctctctttgaagatcctccgcctacccgccccagtcgtccctggagagacctgcctgaaactggagtctggccccctgaaccgcctagaacggatcctcctcaacctccccggcctgacgacccttggccggcaggaccccagcccccagaaaacccctggcctcctgcccctgaggtggacaaccgacctcaggaggagccagacctagacccaccccgggaagagtacagataatggagtcccctcagccgttctgttcccaggcatctccaggcacccacgccctctccaccctctgattccccgtgaattcttcccaatttagcctatctccttaaacctcttcctcattccctcggttttattctgaacccgtaaggtggtgttctcaatatttcctgtcccctcctgagatccatacttagtcctcacatcgcccgttttttcctctgacagcctaagcctactctcctacctcgcctccaggcctcggccccacctacctcccacccggtcttcctgcccgcgcgatcgctggggcagggctatggtactgtgttcccttctgccacctggtggccggcggcaggaactatcagtagacgctgctgcttccatgaaacggaaaaataaaaatcatgttttcttaa

SEQ ID NO: 172349 - DNA, 1152 bp, Homo sapiens
  Payload ID: 13883
  Gene Symbol: PSORS1C2
  Gene Name: psoriasis susceptibility 1 candidate 2
  Uniprot ID: Q9UIG4
  ENST ID: ENST00000416027
  CDS Start-End: 325-735
gtgattacggagatgccaagtgggtattgactgctccagggtgtggatggagggtgtgaaaaccagggtggggtgacgcaggctctgggtcatgatagggagagcaggcagctgggtcctgggctggaggactaaaataagggacgccaccttcaggggtgacacatcagcccaggccttcccaacgggtttgaccagttctgttctgatggtattcctgtgccactgggctggcccctcctccactcctcccctataaagcctcttggggttcccaggcacccagactcagcccaccccagctttgggggccagtacatagccatgatcctcaactggaagctcctggggatcctggtcctttgcctgcacaccagaggcatctcaggcagcgagggccacccctctcacccacccgcagaggaccgagaggaggcaggctccccaacattgcctcagggccccccagtccccggtgacccttggccaggggcaccccctctctttgaagatcctccgcctacccgccccagtcgtccctggagagacctgcctgaaactggagtctggccccctgaaccgcctagaacggatcctcctcaacctccccggcctgacgacccttggccggcaggaccccagcccccagaaaacccctggcctcctgcccctgaggtggacaaccgacctcaggaggagccagacctagacccaccccgggaagagtacagataatggagtcccctcagccgttctgttcccaggcatctccaggcacccacgccctctccaccctctgattccccgtgaattcttcccaatttagcctatctccttaaacctcttcctcattccctcggttttattctgaacccgtaaggtggtgttctcaatatttcctgtcccctcctgagatccatacttagtcctcacatcgcccgttttttcctctgacagcctaagcctactctcctacctcgcctccaggcctcggccgcacctacctcccacccggtcttcctgcccgcgcgatcgctggggcagggctatggtactgtgttcccttctgccacctggtggccggcggcaggaactatcagtagacagctgctgcttccatgaaacggaaaaataaaaatcatgttttcttaa

SEQ ID NO: 172350 - DNA, 1152 bp, Homo sapiens
  Payload ID: 13883
  Gene Symbol: PSORS1C2
  Gene Name: psoriasis susceptibility 1 candidate 2
  Uniprot ID: Q9UIG4
  ENST ID: ENST00000413924
  CDS Start-End: 325-735
gtgattacggagatgccaagtgggtattgactgctccagggtgtggatggagggtgtgaaaaccagggtggggtgacgcaggctctgggtcatgatagggagagcaggcagctgggtcctgggctggaggactaaaataagggacgccaccttcaggggtgacacatcagcccaggccttcccaacgggtttgaccagttctgttctgatggtattcctgtgccactgggctggtccctcctccactcctcccctataaagcctcttggggttcccaggcacccagactcagcccaccccagctttgggggccagtacatagccatgatcctcaactggaagctcctggggatcctggtcctttgcctgcacaccagaggcatctcaggcagcgagggccacccctctcacccacccgcagaggaccgagaggaggcaggctccccaacattgcctcagggccccccagtccccggtgacccttggccaggggcaccccctctctttgaagatcctccgcctacccgccccagtcgtccctggagagacctgcctgaaactggagtctggccccctgaaccgcctagaacggatcctcctcaacctccccggcctgacgacccttggccggcaggaccccagcccccagaaaacccctggcctcctgcccctgaggtggacaaccgacctcaggaggagccagacctagacccaccccgggaagagtacagataatggagtcccctcagccgttctgttcccaggcatctccaggcacccacgccctctccaccctctgattccccgtgaattcttcccaatttagcctatctccttaaacctcttcctcattccctcggttttattctgaacccgtaaggtggtgttctcaatatttcctgtcccctcctgagatccatacttagtcctcacatcgcccgttttttcctctgacagcctaagcctactctcctacctcgcctccaggcctcggccccacctacctcccacccggtcttcctgcccgcgcgatcgctggggcagggctacggtactgtgttcccttctgccacctggtggccggcggcaggaactatcagtagacagctgctgcttccatgaaacggaaaaataaaaatcatgttttcttaa

SEQ ID NO: 172351 - DNA, 1152 bp, Homo sapiens; identical to SEQ ID NO: 172350
  Payload ID: 13883
  Gene Symbol: PSORS1C2
  Gene Name: psoriasis susceptibility 1 candidate 2
  Uniprot ID: Q9UIG4
  ENST ID: ENST00000422316
  CDS Start-End: 325-735

SEQ ID NO: 172352 - DNA, 1152 bp, Homo sapiens
  Payload ID: 13883
  Gene Symbol: PSORS1C2
  Gene Name: psoriasis susceptibility 1 candidate 2
  Uniprot ID: Q9UIG4
  ENST ID: ENST00000458589
  CDS Start-End: 325-735
gtgattacggagatgccaagtgggtattgactgctccagggtgtggatggagggtgtgaaaaccagggtggggtgacgcaggctctgggtcatgatagggagagcaggcagctgggtcctgggctggaggactaaaataagggacgccaccttcaggggtgacacatcagcccaggccttcccaacgggtttgaccagttctgttctgatggtattcctgtgccactgggctggcccctcctccactcctcccctataaagcctcttggggttcccaggcacccagactcagcccaccccagctttgggggccagtacatagccatgatcctcaactggaagctcctggggatcctggtcctttgcctgcacaccagaggcatctcaggcagcgagggccacccctctcacccacccgcagaggaccgagaggaggcaggctccccaacattgcctcagggccccccagtccccggtgacccttggccaggggcaccccctctctttgaagatcctccgcctacccgccccagtcgtccctggagagacctgcctgaaactggagtctggccccctgaaccgcctagaacggatcctcctcaacctccccggcctgacgacccttggccggcaggaccccagcccccagaaaacccctggcctcctgcccctgaggtggacaaccgacctcaggaggagccagacctagacccaccccgggaagagtacagataatggagtcccctcagccgttctgttcccaggcatctccaggcacccacgccctctccaccctctgattccccgtgaattcttcccaatttagcctatctccttaaacctcttcctcattccctcggttttattctgaacccgtaaggtggtgttctcaatatttcctgtcccctcctgagatccatacttagtcctcacatcgcccgttttttcctctgacagcctaagcctactctcctacctcgcctccaggcctcggccccacctacctcccacccggtcttcctgcccgcgcgatcgctggggcagggctacggtactgtgttcccttctgccacctggtggccggcggcaggaactatcagtagacagctgctgcttccatgaaacggaaaaataaaaatcatgttttcttaa

SEQ ID NO: 172353 - DNA, 4996 bp, Homo sapiens
  Payload ID: 13884
  Gene Symbol: PPTC7
  Gene Name: PTC7 protein phosphatase homolog
  Uniprot ID: Q8NI37
  ENST ID: ENST00000354300
  CDS Start-End: 290-1204
acgctagtggagcggaagatggcggcggcggcggcggccgctgcagccgggacttcagttgggctgaggcggaggagccgccgcttctgacctcgctctggctccggtgcgcgcggctgagcgcgtgcgaggccccgcgcgtcgggcaggggcggcggcggccactgcgcgccgccctgaggagcgccccagcggcggcgcgactgcggctgaggagagagccggctccgggcctccgcgtcctcctgctcccccggccccccgcctcctcgggggggcggcggcggcgatgttctcggtcctctcgtacgggcggctggtggcccgcgccgtgctcggcggcctctcgcagaccgaccccagggccggcggcggcggcggcggcgactacggactggtgacggccggctgcggcttcgggaaggacttccgtaagggcctcctcaagaagggcgcgtgctacggggacgacgcgtgcttcgtggcccggcaccgttccgcggacgtgctcggggttgcagatggtgtaggaggctggagagactatggagttgatccatctcaattctcagggactttaatgcggacgtgtgaacgtttagtaaaagaaggacggttcgtacctagtaatcccattggaattctcaccacaagctactgtgagttgctgcaaaataaagtccctttgctcggtagcagcaccgcctgcattgtggtgctggacagaaccagccaccgcttacacacagcaaacctgggcgattcaggcttcctggttgtcaggggtggtgaagtcgtgcaccgatcagatgagcagcagcattacttcaacactccattccagctctcaatcgctccccctgaagccgagggagtcgtcttgagcgacagtccggatgctgctgatagcacgtctttcgatgtccagctaggagacattatcctgacggcaacagatggactctttgacaacatgcctgattatatgattcttcaggagctaaaaaagttaaagaattcaaattatgagagtatacaacagactgccagaagcattgctgagcaagctcatgagctggcctatgacccaaattatatgtcaccttttgcacagtttgcatgtgacaatggattgaatgtgagaggtggaaagccagatgacatcaccgtccttctttcaatagtggctgagtatacagactagctgaggtgtcaagtcctgcctttcctttcatcatcccaaatttcccctgccatgtgtgctgatcctgctggcaggaccacatttctttgccactgatctcaatggccagtgatgtaagtcttttgcctgtcttcttgagactcgttgagatctttgttgagaaccactactatcattcactagctcatatctgccggcagcaattgaagagatccaatatttgaagattggccttcatttctcgatgttctttccatgatggggatggaggtgttcagtgccaccgtggctgttacttttcaaagtagttgaagtattgaaaatgagtaatgttggtaaagtgaattcaaaatcctagtatgctaaagggatggtacaagtctaacacaaattgtacgtaatgatacatctactagaaacatacattattcatcaaaagaaatgttacatgtgtactccacaggcatagtctttgttatgatgattggtgtggctttatgtctttgttataaactcctatttttcaggggcttatgattctgctctaaaacattgctctgggttatacagttttgatcccaaaagcttttttgttacaaatcgggagaaaaatccattttagttctatggatggaaatatttcatgcttttaaaaagatgtttgtgttcctgtggttaaagttttggcagtttattgattagtccaaatcacaggctaaggcctgatctccaggaggggtaggggagacactttaccagtatttttttatggaaataatactcaaggttgtaaaacccctcaaagcctagaaatttaattgttatggctgaaattcctcctagttgtctgatagaatgcccctgaatgggaactctaggtcccaaggcctgaagggttgagaacagacagctgtaactttgaattttgttggctttcagtggtcatgctacctacccatactcgtactctcagaccttttattagtagccttgctttctatagagcatgcaccaaatccagtgagtccatgtggagagagcactgtgtgcgcagcggcagcagcacagacgtccatgaggaaaactcccagtgatgatctgacatttacaattaccccacatggaaatttaggggtttctgaatcaagcttaatgtttacagtttccaaatagccattttgcagtgtatagtttccttacaaaactaccccgcattcagttttcacattatctgcaagctgaaacttatttttaagttttgtgtacaagttgactgctgtaaagatatatatttttgggtcagtttttttccttcattaacttggtggtagaaaaaaatatatacttagaaatccttaaattaaagccatgttttatatataagtcaggtaacattggtgtatagatgagaatgcaattaaacctgatgagaatctacttgagaatatagaaagtctttctctaaaggagatactgactccctggtttattgcattaaaatttatgtttgaggttacctcaacttgttttaaaagattttgttttgtgaatttgtactgtatatttgagtaactgtcaggcttttatttaaaattgtttaacatgtaccatgtacatgtcattactatatttcaatgcatcatgcttgtaacaggcatttcatttataataagaatgagttattcatttgtaagccgttcagtaatttatctactattcctaaattggcataatgttagataatctattttgaatcacctttaattacatgtcagaatgccttaactaccctaacttgacaaaacagaattctttggtagacgcggtgggggcggggtggggggtctggacggagtctctatttaaggagaaatcatcatgctatgataaaacacagaagcatgagtggcaagtggcggggtatttattttgcacaaactatttgcagtctctgtgtatttaaaaagtaaagaaagttgcatccagaagggttttgttagaatgaatacatttatattaggactgacaacttcagctcttttgtttaggttttcaattatttttggtaagagtatgtagccttatgatctggatatattttgcattcattttccaacgcctacatttaattcctggtaagagcagtgctcgtcaagtttctggtttttctctgctctcatttaacccgtcaaacacaatctttgtaaagctagattggtggtgttttatacaacttatttactcagcttacctttttgagaaacgattgttagaaattgacgatgtgtttgttccagtgatactgaaagtagtgggggcaagaattgagtttcacagtggaattggctttggatctggcctatagattagtgacataaaatattttctctattttcccctgttctttttgtgttatgcacttaattttatgactgccgggggggtcagctggagtgctgcttaacaagtatctctcctactctcagtggtcagaggctgtgttggacccatagtagaattttccaggtcacagacccaagcttccatgggttgttactgtgctgtaccacttggtgggtctgattctgaacctgatgtgtgtgttaattatattttaagcaacacacacacacacacacgcctcatgtaatggacttttataacaaaagaaaaaatttggatttctaatttacaaatggcaaattatttatccctctctggatgcaccaaagaccagtaaagtttatagcttttccatctatatttataaagcaatactgtattataaaaatcaatatttttatcacatgcttgaaatttttattttgttgttttaaaatgtgcactctaaacatatcagaaccttatttcttcctatgaacttaagctgcctgcgcacaaaaaaaaaaaaaatttaccaaatggagatgcagtagagtccataggctctaaaaactaaaagaaatgggatgcagggggaacaagttatttgtcctgagttactgtacttgcttgacatggttgttgggtactaaatcacaaaagaatccattccaggtatgcatgtctgggggttgggctgtgtctagattagaaactgggtttcaagctttgcatgatgggagagcgtcctctcctctatcagctgcgtgtgttctggataggacagtagcccggagatggaaaccaccttcagtaccattagcccaccataccaagtaacaagttaggcaggaatcgtgggaatttattgagtcagctttgagtgtttgagagaatgtaaacaagattggctcgaattgtaaacgtttgtactttggatgagttcatggttctttaggtcaccttaataccagctatctttggtagaagctacagcattcagtttctctggaaactgtatcacatttttgcattttaaaaattttacagtatcaaaaaaccaaaatctgcttatgaaacaaaacatgaagcaggacatatttggattctatttatttaaaattaaattctttgcaaaattgaacttctcaactaaaacgtgtccatgtcagaattttaactgttagcaggtagtttgtggcaaagatggctaaataatgaagcaaattagaatctgtgtgtatactaatgagctgctttttttctgttgagactatcattatttgtcttattacccaagaggcaattacctgaatttggatgtctgaattataacttatgcaggaatagttctgtaaatacatttaaataaactgtaaagatatttaataaatatagtatttatactaa

SEQ ID NO: 172354 - DNA, 2660 bp, Homo sapiens
  Payload ID: 13885
  Gene Symbol: PINK1
  Gene Name: PTEN induced putative kinase 1
  Uniprot ID: Q9BXM7
  ENST ID: ENST00000321556
  CDS Start-End: 95-1840
cgcagaggcaccgccccaagtttgttgtgaccggcgggggacgccggtggtggcggcagcggcggctgcgggggcaccgggccgcggcgccaccatggcggtgcgacaggcgctgggccgcggcctgcagctgggtcgagcgctgctgctgcgcttcacgggcaagcccggccgggcctacggcttggggcggccgggcccggcggcgggctgtgtccgcggggagcgtccaggctgggccgcaggaccgggcgcggagcctcgcagggtcgggctcgggctccctaaccgtctccgcttcttccgccagtcggtggccgggctggcggcgcggttgcagcggcagttcgtggtgcgggcctggggctgcgcgggcccttgcggccgggcagtctttctggccttcgggctagggctgggcctcatcgaggaaaaacaggcggagagccggcgggcggtctcggcctgtcaggagatccaggcaatttttacccagaaaagcaagccggggcctgacccgttggacacgagacgcttgcagggctttcggctggaggagtatctgatagggcagtccattggtaagggctgcagtgctgctgtgtatgaagccaccatgcctacattgccccagaacctggaggtgacaaagagcaccgggttgcttccagggagaggcccaggtaccagtgcaccaggagaagggcaggagcgagctccgggggcccctgccttccccttggccatcaagatgatgtggaacatctcggcaggttcctccagcgaagccatcttgaacacaatgagccaggagctggtcccagcgagccgagtggccttggctggggagtatggagcagtcacttacagaaaatccaagagaggtcccaagcaactagcccctcaccccaacatcatccgggttctccgcgccttcacctcttccgtgccgctgctgccaggggccctggtcgactaccctgatgtgctgccctcacgcctccaccctgaaggcctgggccatggccggacgctgttcctcgttatgaagaactatccctgtaccctgcgccagtacctttgtgtgaacacacccagcccccgcctcgccgccatgatgctgctgcagctgctggaaggcgtggaccatctggttcaacagggcatcgcgcacagagacctgaaatccgacaacatccttgtggagctggacccagacggctgcccctggctggtgatcgcagattttggctgctgcctggctgatgagagcatcggcctgcagttgcccttcagcagctggtacgtggatcggggcggaaacggctgtctgatggccccagaggtgtccacggcccgtcctggccccagggcagtgattgactacagcaaggctgatgcctgggcagtgggagccatcgcctatgaaatcttcgggcttgtcaatcccttctacggccagggcaaggcccaccttgaaagccgcagctaccaagaggctcagctacctgcactgcccgagtcagtgcctccagacgtgagacagttggtgagggcactgctccagcgagaggccagcaagagaccatctgcccgagtagccgcaaatgtgcttcatctaagcctctggggtgaacatattctagccctgaagaatctgaagttagacaagatggttggctggctcctccaacaatcggccgccactttgttggccaacaggctcacagagaagtgttgtgtggaaacaaaaatgaagatgctctttctggctaacctggagtgtgaaacgctctgccaggcagccctcctcctctgctcatggagggcagccctgtgatgtccctgcatggagctggtgaattactaaaagaacatggcatcctctgtgtcgtgatggtctgtgaatggtgagggtgggagtcaggagacaagacagcgcagagagggctggttagccggaaaaggcctcgggcttggcaaatggaagaacttgagtgagagttcagtctgcagtcctctgctcacagacatctgaaaagtgaatggccaagctggtctagtagatgaggctggactgaggaggggtaggcctgcatccacagagaggatccaggccaaggcactggctgtcagtggcagagtttggctgtgacctttgcccctaacacgaggaactcgtttgaagggggcagcgtagcatgtctgatttgccacctggatgaaggcagacatcaacatgggtcagcacgttcagttacgggagtgggaaattacatgaggcctgggcctctgcgttcccaagctgtgcgttctggaccagctactgaattattaatctcacttagcgaaagtgacggatgagcagtaagtaagtaagtgtggggatttaaacttgagggtttccctcctgactagcctctcttacaggaattgtgaaatattaaatgcaaatttacaactgcagatgacgtatgtgccttgaactgaatatttggctttaagaatgattcttatactctgaaggtgagaatattttgtgggcaggtatcaacattggggaagagatttcatgtctaactaactaactttatacatgatttttaggaagctattgcctaaatcagcgtcaacatgcagtaaaggttgtcttcaactga

SEQ ID NO: 172355 - DNA, 1006 bp, Homo sapiens
  Payload ID: 13886
  Gene Symbol: PCBD1
  Gene Name: pterin-4 alpha-carbinolamine dehydratase/dimerization cofactor of hepatocyte nuclear factor 1 alpha
  Uniprot ID: P61457
  ENST ID: ENST00000299299
  CDS Start-End: 252-566
cggggtgggattccaacccagaagcgggcatttggagccctcatgcttcaccctagctccctgaaacaagcacggaggatggctctgagcagcgaggaaagtgctggaagcaagcaggccgagcgcgtccctggctggggacgttaatcattaccggagggcggcccgagcgcggccccgccccgggacggcagcctgcgcgcccggccgccgcctgccctctccgctggccacctgctgccgcccgcgccatggctggcaaagcacacaggctgagcgctgaggagagggaccagctgctgccaaacctgagggctgtggggtggaatgagctggaaggccgtgatgccatcttcaagcagtttcatttcaaagacttcaacagggcctttgggttcatgacaagagtggccctgcaggctgagaaactggaccaccatcctgaatggtttaacgtgtacaacaaggtccacatcacgctgagcacccatgagtgtgccggcctttcagaacgggacataaacctggccagcttcatcgaacaagtagcagtgtccatgacatagaccctgcccttcctctttgaattcttccgggggaaggggtgactgaactgggagtccagggagggagctgaggagcccttaccctcccaccactcccctcccaagacccagccgccgccgttgagggctgagtccttgctgtgggatgtgccagtgtccccaccaacaccaggaatttagaccttttccctgcaccactctcttcatcctgggggctctgttacactaatttgaataaactctcccctttctttgcaacttcccagcaacaataatgattttcttgccaggccgtctcttgctccctaattcatttcccaggaagctgtgatacagggtgaaataaagtcttgtcttagaaaccaggaccctaaaccccacactatgtaatagaaacacatgtgtttttatgtctcaaataaaactattatatcacttgg

SEQ ID NO: 172356 - DNA, 1223 bp, Homo sapiens
  Payload ID: 13887
  Gene Symbol: PCBD2
  Gene Name: pterin-4 alpha-carbinolamine dehydratase/dimerization cofactor of hepatocyte nuclear factor 1 alpha (TCF1) 2
  Uniprot ID: Q9H0N5
  ENST ID: ENST00000254908
  CDS Start-End: 235-627
agagtccacctggcggccaagggcgctggcgaccgctgaagctcctgggggtgttcggggtccgggctgcgcctgtgcccgcgggaaggctgggcgcttcccacacacagaccccgctccgggccagccccgcagggagactaccagggctggcggtagctgggcgtggtcgggtcgggggcggctgtgggcggccggcaggcagcgcgcggggcagccctcggcagacggccaatggcggcggtgctcggggcgctcggggcgacgcggcgcttgttggcggcgctgcgaggccagagcctagggctagcggccatgtcatcaggtactcacaggttgactgcagaggagaggaaccaagctatacttgaccttaaagcagcaggatggtcggaattaagtgagagagatgccatctacaaagaattctccttccacaattttaatcaggcatttggctttatgtcccgagttgccctacaagcagagaagatgaatcatcacccagaatggttcaatgtatacaacaaggtccagataactctcacctcacatgactgtggtgaactgaccaaaaaagatgtgaagctggccaagtttattgaaaaagcagctgcttctgtgtgatttcttccaaaatacatgtaaaatcttgtacacatcttagctgcaatgtatgttgaaggaaatttatgtgaacaaatagagttgttctttttctcttttttttaagacagagtgttgctctgtcgcccaggccagagtgcagtggtatgatctcggctcactgtaacctccgcctcccaggttcaggtgattctcctgcctcagcctcctgagtagctgggattacaagcacgtgtcaccacgcctggctaatttttgtatttttagtatagacagggttttaccacgttggtcaggctggtctcgaactcctgacctcgtgatccgcctgcctcagcctcccaaagtgctgggattacaggcatgagccaccatgcctggctgttgaattgttcttaaggcatcatatctagaagcaaagaaaaaagaaaaataacaatttaagttgtgtaaattgtttgcctttatatattacatttggtaaaatcagtgcttaaatacgcaatgatttaaactggaacctgaggtatttttcatgctatctaatcatatacctaagataaaccaacccagttacttatattaataatattcag

SEQ ID NO: 172357 - DNA, 5621 bp, Homo sapiens
  Payload ID: 13887
  Gene Symbol: PCBD2
  Gene Name: pterin-4 alpha-carbinolamine dehydratase/dimerization cofactor of hepatocyte nuclear factor 1 alpha (TCF1) 2
  Uniprot ID: Q9H0N5
  ENST ID: ENST00000512783
  CDS Start-End: 21-413
cagccctcggcagacggccaatggcggcggtgctcggggcgctcggggcgacgcggcgcttgttggcggcgctgcgaggccagagcctagggctagcggccatgtcatcaggtactcacaggttgactgcagaggagaggaaccaagctatacttgaccttaaagcagcaggatggtcggaattaagtgagagagatgccatctacaaagaattctccttccacaattttaatcaggcatttggctttatgtcccgagttgccctacaagcagagaagatgaatcatcacccagaatggttcaatgtatacaacaaggtccagataactctcacctcacatgactgtggtgaactgaccaaaaaagatgtgaagctggccaagtttattgaaaaagcagctgcttctgtgtgatttcttccaaaatacataagtctgagaggctaaacttgatggctgtgttaacatatgtcacgtgtagcacagtggagaaagcaggatatggctcataatgacagtggtgaagacctgcgaatgaagttgctagttatcacctacattagggtttgacataggtctatgttatgggtcgctgcatctgctggaactcacagactttactatagagaatcaaagatcccgtatccgaagtctatggaaatgctcatggtggtaaattccaacagaatgaaacaccaaacttgcttaaagtaactcacgtttcaatttgaaagagatattgtcaaaattggaggcccccaggttcctgtctgttccaaatctttgcatgatgacagtggtttctctgatgtggtaagctttggctttcttctgttttctttctaaaagatcactggagtagagaggagttaaacagacatgacctttgacctcttgcatgacctccacagatagcaaaccgggccgacacatggttgacgatgtccttttctacaatgaagttaatgaaagttctgaaaatagtgattactttctgacattgataggatttaggaaacctctggataaatagcttaagcatggctgtttatgtttttgctatagacaaaaagcagcagcatgtacattgtatttggacacaagcctgcctcggttaatatattgaactattggaccactagggttagtagggagcggtctgtacactttctgattcagcattcagaaacattctaggtggactctgtagctttcagttttgtaaagttatcagaaaaacatcgggagggtttggccatcatatgtgagctttgtgtttcaatgccagttactcaggattagtaaattaatgactgtccagaggacttcagggtcaccaagctgctgcacctgccattggctgactctccccggctatctgtggctgagatggtgctgcttaggtcacgcagagcatgagctgctgctgaaagggcacaggagatggcccttgggcttctcatcccaggatgcctgccctgcccaccaatccatgagaagatatgtatgatttcagtaggccctggatcagcttgtcacctctggtttcctgtttgctttccactcactcagctggagtttcatttccagactaaagtcttcatcattggcttcagaaacagcattcatctgtggctgtgctgatgtagtacaccaagaacaactgggctcttctctgtcactttcagtgggctaccttccctcacctctccaagcagcatgaaagaattctttacatttttaatctcttttttgtttttccctgaaagtatgctttggtgcttaaagagagaagtcacaaaagtatactactgagtttcctggagatgaaatcctgttgtccctagctatgtgaatgagcacagggatccctgatgccattattttgtatattcatacggcacacacttactgagggccttctgtgtgccctaggggattgagcacagtgacatatcagggcaggtagaaacagatggagagctgatgcgggctgtcttagagcagctgccccaggaggcccctgtggatggatgttgggcaggagccctgagacgttaggggcatataactaaaggacatagcaggagttataggaggagctgatccctgagggaaacaatgaagacggagaagatggggctaaagtttgaattgtggggacattaatcacagtgattcttaaaactttgctgttgatgattttaaatggagaaaatgagtacgtaagatgttatttcccagttcagtatattggttgcccacaaagtattttcctaccatgaatggtcatatatacttgttgtagaataccagggacagcagagatggtggggtagttacttccttttcttacagcccaagaactttggtgtccaggagattgaccaatttagccactgagcatttaatacaacacagggctacccagatcccactgtcctgatttgccctgaaagccaaaggagttaggagaaggtgagtggggagaatatattaatcctgagagttgaacagagcaaaaatccctattacttttgtacttaaaacatctctgccacatgtgctcactctttatattctgtttaggtggtttatatgtgcacatcccatcctatgcctgcagttagccaactcagggtttatattgcctcctttctttttttctttttttttttttttttaagagatggggtctcattctatcatgcagactggagtgcagtggtgtgatcacagctcattgtaacctccaacgcctggactaaagtgatcctcctaccttggcctctctggtagctgggactacaggtgcatgccaccacacccacctaattttttttatttttattttttgtagagacagtctcactatcttgctcaggctagtcctgaactcctgggctcaagttatcttgctgcctcagcctcccatgggtaatttttatttcctttttttttttttttggagatggagtttcgctcttgtcgcccaggctggagtgcaatggcacgatcttggctcactgcagtctccacctcctgggttcaagtgattctccatcctcagcctcctgagtagctgagattacaggcaactgccaccatgcgcggctaatttatgtatttttttttagtaagagatggggtttcaccatgttggccagactagtcttaaactcctgacctcaagcgacctgcctgccttggcctcccaaagtgctgggattacaggcatgagccgctatgcctcgtcgctgatttttatttcttattttttttttagagatgggggtctcactatgttgctcaggctgatctcaaactcctggcctcaagtgatcctcccaccttagcctcccaagttgctgggattataagtgtgagccactatccctacctcactattaccttctttgcttctcttgttttcttttgttctaagtcaaacccatcacaatcttttcttgtccttccaggtgttttccagtgctgtgccctggatgtgctctctttctcttagagcccagagaacttgcttttcccccttatatatgacccttaactttttctaacacattattaagggcctgtgtctatcagctgggggcacttcttgaagggagggcctttgtgtggtctgtttctagtgacttccagctttaacccagagcctcatgattgctgggtgcccatagcctttttgctgaatggaggcactcagtctccttgggaagagagaatccatgatagacccacttgggagctccccacttcaggggcctacacactggtaatgcaacagaatgcccaagagtgacctcataaagcaaggattcccttcgtggccccttctctgctgcctctcagaatccagacgctaaggaaaatccctaagcagagattttctgttggatgctaaaagcaaggaataaaagttgaaaatttggaaaatgtctcaacaccgtcaccagcgccactcgagagtcatttctagttcaccagttgacactacatcggtgggattttgcccaacattcaagaaatttaagtaaatattatctatctccattgcctgttaagaaatgtgctagtagaagtgtgagggcagggtgtcagtgttctctcagcctcttccctcagatactcgtctgcttaccaaaataagttgcatgtccttgacaatctggtttctatgattggtgaggctggcatgctattacctttatgtgccctgtagacttgaatgaccagtttgaccagtttgactgttagataatctgaaggcttttctctttttttataatagaccccatctcaaatcagataatgaaaattacatatcttgatatattagaaaagtatatacattctggctgggcacggtggctcacacctgtaatccctgcactttgagaggctggggcggatcacttgaggtcaggagtttgagaccagcctggccaacgtggcgaaaccccatctctactaaaaatacacagattagcccggagtgatggtgtgcacctgttgtcccagctactcaggatgctgaggcaggagaatccctttaacctggggggcgaaggttgcagtgagccaagattgcaccactgcactccagcctgggtgacagaacgagactctgtctcagaaaaaaaaaaaaagaaaaggaaaaagaaaaatatatattctatatttttttaacttatgagaatgtgttcatttcatttgtaacatataatgggaaacagtaatacgtactctgagaaaaattgcaaagcacagataaatggaaataaacaggaaaaagaatcacctataacctcaccatccatagacagacactgttaaaattttggcatatttcctgctgattttttctactgctgatttttgcacaggtgagataattttgaacagagaattttgtatctttggtttttgtgttttgctgcacacaaaaacaaaagatataaaaatggatcataaacatttttctaaatcctgaaaaatgcatagacatattttagtgcctgtatttcacaagatggacataccataatttacttacacagtcctttttgttagatgtttaagttgttttcaagcttctcagtgctggaaaaaatactgagatagacatgtttagttgaagttatttcatttcaggttatattatcttgggtcagagaatgaatggttctcaggcttttcaaaagagctggtcagtttttatgcctctggcagtttttgagagtgctcaatcatactacactgttgccagcattagatcttatcacatttaagtcattgctaattttataaacaaaaacaatggttttactttgcatctccctgattggtattgctgtagaacatatttggagaagtttgtttgtctttggtgtttatttcatgaatagattgtgtgcccattttctcttggggtattcagttttttattactgatgtgagcatgtgtatgggtgattatttgatgattatcagttttgcttagtagactggcaatatttagtcttgctgtcactgtgttcccagtgcctactagattgcttgatatgtagttgccactcaataaagatttgttgagtcaatgaa

SEQ ID NO: 172358 - DNA, 961 bp, Homo sapiens
  Payload ID: 13887
  Gene Symbol: PCBD2
  Gene Name: pterin-4 alpha-carbinolamine dehydratase/dimerization cofactor of hepatocyte nuclear factor 1 alpha (TCF1) 2
  ENST ID: ENST00000504352
  CDS Start-End: 1-360
cggcgcttgttggcggcgctgcgaggccagagcctagggctagcggccatgtcatcaggtactcacaggttgactgcagaggagaggaaccaagctatacttgaccttaaagcagcaggatggtcggaattaagtgagagagatgccatctacaaagaattctccttccacaattttaatcaggcatttggctttatgtcccgagttgccctacaagcagagaagatgaatcatcacccagaatggttcaatgtatacaacaaggtccagataactctcacctcacatgactgtggtgaactgaccaaaaaagatgtgaagctggccaagtttattgaaaaagcagctgcttctgtgtgatttcttccaaaatacatgaggaacgatgatgaatgtcgggcatttgtgaagagagtcataatgagccgtttctttaagataattatgattagcactgtcacatcgaatgcgttttttatggccttgtggaccagttatgacataaggtaccgcttgttcagacttcttgagggtggtggtacagccattgaaaataacatgtatgaaagcccctggttaactgtgaaactgagaaattattaacacttctgggaactccactgaaggtgccgggaaagatgtgagagagccctgatctctcacctctggctaaccttgaggctctgtgcaagcaggaaatgaaggctgaggcagagtgttctcggagatcttctttgtgtccatctgcacatctgagttgtccatgaaggtctatgtggaccccatcaactactggaagaacggctacaacctgctggatgtgatcattatcatcgttatgtttttaccctatgccctccgccagctcatgggcaaacagttcacttacctgtatatcgctgatggcatgcagtccctgcgcatcctcaagcttatcggctatagccagggcatccggacg

SEQ ID NO: 172359 - DNA, 1790 bp, Homo sapiens
  Payload ID: 13888
  Gene Symbol: PTGES3L-AARSD1
  Gene Name: PTGES3L-AARSD1 readthrough
  Uniprot ID: Q9BTE6
  ENST ID: ENST00000360221
  CDS Start-End: 146-1723
tggagattccctgctccaagtcttctgggcgctccaggttctgtgaggccccacgggagccccggacccctggtctctgtaactgtggggtgagggaaggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcctgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactcagaa

SEQ ID NO: 172360 - DNA, 1670 bp, Homo sapiens
  Payload ID: 13888
  Gene Symbol: PTGES3L-AARSD1
  Gene Name: PTGES3L-AARSD1 readthrough
  ENST ID: ENST00000409103
  CDS Start-End: 136-1623
ctgctccaagtcttctgggcgctccaggttctgtgaggccccacgggagccccggacccctggtctctgtaactgtggggtgagggaaggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagcttttgaagaaggtcagcaccaagagacctccacctgccatggatgatttggatttcaccaccaccgtggtctcctgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaa

SEQ ID NO: 172361 - DNA, 2042 bp, Homo sapiens
  Payload ID: 13888
  Gene Symbol: PTGES3L-AARSD1
  Gene Name: PTGES3L-AARSD1 readthrough
  Uniprot ID: Q9BTE6
  ENST ID: ENST00000409399
  CDS Start-End: 219-1979
ggcggggcctgaagtacccaagtccccgagggcgcgccttccccgggaatttaattcaggacaataatgttttattgagcgcctattgtgaatcagacactgagcagtaagcgtcggagaaacagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcctgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttggtcaataaaatagattgactc

SEQ ID NO: 172362 - DNA, 566 bp, Homo sapiens
  Payload ID: 13888
  Gene Symbol: PTGES3L-AARSD1
  Gene Name: PTGES3L-AARSD1 readthrough
  ENST ID: ENST00000452752
  CDS Start-End: 1-566
gcagcacgcccggaccttgtggtacgacaggcccagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcctgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccc

SEQ ID NO: 172363 - DNA, 584 bp, Homo sapiens
  Payload ID: 13888
  Gene Symbol: PTGES3L-AARSD1
  Gene Name: PTGES3L-AARSD1 readthrough
  ENST ID: ENST00000423601
  CDS Start-End: 1-160
aggcagctgctgggggcgtccccaggatctaaagatagcggcccctgcctggaactctaaatgccaccctggagcgggagccgcaatggcacgccacacctcaacttctcttcaggcagcacgcccggaccttgtggtacgacaggcccagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgct

SEQ ID NO: 172364 - DNA, 594 bp, Homo sapiens
  Payload ID: 13888
  Gene Symbol: PTGES3L-AARSD1
  Gene Name: PTGES3L-AARSD1 readthrough
  ENST ID: ENST00000454303
  CDS Start-End: 198-594
aactctaaatgccaccctggagcgggagccgcaatggcacgctccactttgaaaaaactgtggcatcaaaggtccctgggtagtcccttcccaaatgacctcagtcttccctctcccacccctatgaagccacacctcaacttctcttcaggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtct

SEQ ID NO: 172365 - DNA, 2150 bp, Homo sapiens
  Payload ID: 13888
  Gene Symbol: PTGES3L-AARSD1
  Gene Name: PTGES3L-AARSD1 readthrough
  Uniprot ID: Q9BTE6
  ENST ID: ENST00000421990
  CDS Start-End: 347-2107
gcaacggcgcggtggcctggaaccccaggggagtggtgggcggggcctgaagtacccaagtccccgagggcgcgccttccccgggaatttaattcaggacaataatgttttattgagcgcctattgtgaatcagacactgagcagtaagcgtcggagaaacaggtgaatgataccggggaaaagtcattccctgtgtgtagcgtctagggcagcctttgccctggttccagcagatgggttgtctcttcatagtctatgcatttctgaagaccccacggtgaagggctgcaaggatgaagctgtcccagagtatctccagagtgcagatcccttggctgccaggtcatgttctctcttcctctcaactgctctcccgaccatataaggagaggcagctgctgggggcgtccccaggatctaaagatagcggcccctgcctggaactctaaatgccaccctggagcgggagccgcaatggcacggcagcacgcccggaccttgtggtacgacaggcccaggtatgtgttcatggagttttgtgttgaggacagcaccgatgtccacgtgcttattgaggatcaccgcattgtgttcagctgcaagaatgccgatggagtggagttgtacaatgagattgagttctatgccaaagtgaactccaaggactcccaggataagcgctcttcccgctctattacttgttttgtgagaaaatggaaggaaaaggtggcctggccgcggcttaccaaggaggatatcaagccagtgtggctgtctgtggactttgataactggagagactgggaaggggatgaagagatggagctggctcatgtggaacattatgcagagcttttgaagaaggtcagcaccaagagacctccacctgccatggatgatttggatttcaccaccaccgtggtctcctgctgtcccgcggagctgcagactgaagggagcaacggcaagaaagaagtgctgagcggtttccaagtggtgctggaagacacagtgcttttccctgagggcgggggacagcctgatgaccgtggtacaatcaatgacatctctgtgctgagagtgactcgccgtggggaacaggctgatcatttcacccagacacccctggatccaggaagccaggttctggtccgggtagattgggagcggaggtttgaccacatgcagcagcattcagggcagcatctcatcacggcagttgctgaccatctatttaagctgaagacaacatcatgggagttagggagatttcggagtgcgattgagctggacaccccctctatgactgcagagcaagtagctgccattgagcagagcgtcaatgaaaaaatcagagatcggctgcctgtgaatgtccgagaactgagcctggatgatcctgaggtggagcaggtgagtggccggggtttgcctgatgatcatgctgggcccattcgggttgttaacatcgagggcgttgattccaacatgtgctgtgggacccatgtgagcaatctcagtgaccttcaggtcattaagattctgggcactgagaaggggaaaaagaacagaaccaacctgatatttctgtctgggaaccgggtgctgaagtggatggagagaagtcatggaactgaaaaagcactgactgctctgcttaagtgtggagcagaggatcatgtggaagcagtgaaaaagctccagaactccaccaagatcctgcagaagaataacctgaatctgctcagagacctggctgtgcacattgcccatagcctcaggaacagtccagactggggaggtgtggtcatattacacaggaaggagggtgattcagagttcatgaatatcattgccaatgagattgggtcagaggagaccctcctgttcttaactgtgggcgatgagaaaggtggtggactcttcttactggcagggccacctgcgtctgtggagaccctggggcccagggtggctgaggtcctggaaggcaaaggagcagggaagaaaggccgttttcagggcaaggccaccaagatgagccggcggatggaggcgcaggcgcttctccaggactacatcagcacgcagagtgctaaggagtgagggcttagggcactcacctcctgtttccacaggaatcttttgg

SEQ ID NO: 172366 - DNA, 1238 bp, Homo sapiens
  Payload ID: 13889
  Gene Symbol: PRY
  Gene Name: PTPN13-like, Y-linked
  Uniprot ID: O14603
  ENST ID: ENST00000303728
  CDS Start-End: 228-671
aagaagaggagcacaccacaccagaaacagacatcttgcagtgtttcactgtctcaaccttatctgcacagtccgaggtcagtctgagagagcttctgagagacccaggatgaagggatgcagtgaggtcaagagcccaaccttctttcactgacacccacctctaaggactcagagagacatgaataaaatgggcctcaacaatcccaagagaccactcaaggacaatgggagccactgggcttggctttctactttcctggagacaagacaatttgaatggcactgactgccagggatgcaatattttatacttctctgagactacggggagcatgtgttctgaactttccttgaacagaggtcttgaggccagaaggaagaaggatcttaaagactcatttctctggagatatgggaaggttggctgtatctcacttccacttcgtgagatgaccgcctggattaacccaccccaaatttcagagattttccaaggctaccaccagagggtgcacggagctgatgcactgagcctgcaaaccaactctctgagaagcaggttatcttcacagtgcctcggacagagcttccttctcaggacactcgagagaggccgtggtttcagggcacttggggacatctgtggccacgttcatgaagaagactaagcctacttcatctcaggacccgcccaagagtggccgcggctttgggacacctggggtcgggtccaccatgaggataaaacctccttctcttctggacatgtccaggagtggccgttgctacaagtcacctggtgctacgaccagggtgagaataaagacgtctcctcaggaccctcccaggagagtacatggcattgagacatctggcggccaagtgaggaaaagacaccctgtctgcagcacccagaactgaggaggggcactgccctgggccttacttcccagccctggcctccaattctgaccttacaaaagtgtcccttgagtgaggcagtgaccacgcattgtcacagctaccaaagtgtggtttgcagatgatctgggcttgtttctggcagagattctggtacagagaaaggagaggcgctgagtggaaccacgatgggctgaggccaggggagacatcacaacctccaacaacactttttttcatgctttaataactcatttttcttagagaactaaagtagttgaaacaatatagaaacattttttaagtaggcatat

SEQ ID NO: 172367 - DNA, 1353 bp, Homo sapiens
  Payload ID: 13889
  Gene Symbol: PRY
  Gene Name: PTPN13-like, Y-linked
  Uniprot ID: O14603
  ENST ID: ENST00000477123
  CDS Start-End: 228-443
aagaagaggagcacaccacaccagaaacagacatcttgcagtgtttcactgtctcaaccttatctgcacagtccgaggtcagtctgagagagcttctgagagacccaggatgaagggatgcagtgaggtcaagagcccaaccttctttcactgacacccacctctaaggactcagagagacatgaataaaatgggcctcaacaatcccaagagaccactcaaggacaatgggagccactgggcttggctttctactttcctggagacaagacaatttgaatggcactgactgccagggatgcaatattttatacttctctgagactacggggagcatgtgttctgaactttccttgaacagaggtcttgaggccagaaggaagaaggatcttaaagactcatttctctggagagacggggtttcaccgtgtttaccatgctgatctggaatccctgtcctcaggtgatctggccgcttcgacctccaaaagtgctgagattacaagcttgaactgccatgcccaatgatatgggaaggttggctgtatctcacttccacttcgtgagatgaccgcctggattaacccaccccaaatttcagagattttccaaggctaccaccagagggtgcacggagctgatgcactgagcctgcaaaccaactctctgagaagcaggttatcttcacagtgcctcggacagagcttccttctcaggacactcgagagaggccgtggtttcagggcacttggggacatctgtggccacgttcatgaagaagactaagcctacttcatctcaggacccgcccaagagtggccgcggctttgggacacctggggtcgggtccaccatgaggataaaacctccttctcttctggacatgtccaggagtggccgttgctacaagtcacctggtgctacgaccagggtgagaataaagacgtctcctcaggaccctcccaggagagtacatggcattgagacatctggcggccaagtgaggaaaagacaccctgtctgcagcacccagaactgaggaggggcactgccctgggccttacttcccagccctggcctccaattctgaccttacaaaagtgtcccttgagtgaggcagtgaccacgcattgtcacagctaccaaagtgtggtttgcagatgatctgggcttgtttctggcagagattctggtacagagaaaggagaggcgctgagtggaaccacgatgggctgaggccaggggagacatcacaacctccaacaacactttttttcatgctttaataactcatttttcttagagaactaaagtagttgaaacaatatagaaacattttttaagtaggcatat

SEQ ID NO: 172368 - DNA, 1238 bp, Homo sapiens
  Payload ID: 13890
  Gene Symbol: PRY2
  Gene Name: PTPN13-like, Y-linked 2
  Uniprot ID: O14603
  ENST ID: ENST00000303804
  CDS Start-End: 228-671
aagaagaggagcacaccacaccagaaacagacatcttgcagtgtttcactgtctcaaccttatctgcacagtccgaggtcagtctgagagagcttctgagagacccaggatgaagggatgcagtgaggtcaagagcccaaccttctttcactgacacccacctctaaggactcagagagacatgaataaaatgggcctcaacaatcccaagagaccactcaaggacaatgggagccactgggcttggctttctactttcctggagacaagacaatttgaatggcactgactgccagggatgcaatattttatacttctctgagactacggggagcatgtgttctgaactttccttgaacagaggtcttgaggccagaaggaagaaggatcttaaagactcatttctctggagatatgggaaggttggctgtatctcacttccacttcgtgagatgaccgcctggattaacccaccccaaatttcagagattttccaaggctaccaccagagggtgcacggagctgatgcactgagcctgcaaaccaactctctgagaagcaggttatcttcacagtgcctcggacagagcttccttctcaggacactcgagagaggccgtggtttcagggcacttggggacatctgtggccacgttcatgaagaagactaagcctacttcatctcaggacccgcccaagagtggccgcggctttgggacacctggggtcgggtccaccatgaggataaaacctccttctcttctggacatgtccaggagtggccgttgctacaagtcacctggtgctacgaccagggtgagaataaagacgtctcctcaggaccctcccaggagagtacatggcattgagacatctggcggccaagtgaggaaaagacaccctgtctgcagcacccagaactgaggaggggcactgccctgggccttacttcccagccctggcctccaattctgaccttacaaaagtgtcccttgagtgaggcagtgaccacgcattgtcacagctaccaaagtgtggtttgcagatgatctgggcttgtttctggcagagattctggtacagagaaaggagaggcgctgagtggaaccacgatgggctgaggccaggggagacatcgcaacctccaacaacactttttttcatgctttaataactcatttttcttagagaactaaagtagttgaaacaatatagaaacattttttaagtaggcatat

SEQ ID NO: 172369 - DNA, 1353 bp, Homo sapiens
  Payload ID: 13890
  Gene Symbol: PRY2
  Gene Name: PTPN13-like, Y-linked 2
  Uniprot ID: O14603
  ENST ID: ENST00000472391
  CDS Start-End: 228-443
aagaagaggagcacaccacaccagaaacagacatcttgcagtgtttcactgtctcaaccttatctgcacagtccgaggtcagtctgagagagcttctgagagacccaggatgaagggatgcagtgaggtcaagagcccaaccttctttcactgacacccacctctaaggactcagagagacatgaataaaatgggcctcaacaatcccaagagaccactcaaggacaatgggagccactgggcttggctttctactttcctggagacaagacaatttgaatggcactgactgccagggatgcaatattttatacttctctgagactacggggagcatgtgttctgaactttccttgaacagaggtcttgaggccagaaggaagaaggatcttaaagactcatttctctggagagacggggtttcaccgtgtttaccatgctgatctggaatccctgtcctcaggtgatctggccgcttcgacctccaaaagtgctgagattacaagcttgaactgccatgcccaatgatatgggaaggttggctgtatctcacttccacttcgtgagatgaccgcctggattaacccaccccaaatttcagagattttccaaggctaccaccagagggtgcacggagctgatgcactgagcctgcaaaccaactctctgagaagcaggttatcttcacagtgcctcggacagagcttccttctcaggacactcgagagaggccgtggtttcagggcacttggggacatctgtggccacgttcatgaagaagactaagcctacttcatctcaggacccgcccaagagtggccgcggctttgggacacctggggtcgggtccaccatgaggataaaacctccttctcttctggacatgtccaggagtggccgttgctacaagtcacctggtgctacgaccagggtgagaataaagacgtctcctcaggaccctcccaggagagtacatggcattgagacatctggcggccaagtgaggaaaagacaccctgtctgcagcacccagaactgaggaggggcactgccctgggccttacttcccagccctggcctccaattctgaccttacaaaagtgtcccttgagtgaggcagtgaccacgcattgtcacagctaccaaagtgtggtttgcagatgatctgggcttgtttctggcagagattctggtacagagaaaggagaggcgctgagtggaaccacgatgggctgaggccaggggagacatcgcaacctccaacaacactttttttcatgctttaataactcatttttcttagagaactaaagtagttgaaacaatatagaaacattttttaagtaggcatat

SEQ ID NO: 172370 - DNA, 5038 bp, Homo sapiens; identical to SEQ ID NO: 171759
  Payload ID: 13891
  Gene Symbol:
  Gene Name: PTPRD
  ENST ID: ENST00000635279
  CDS Start-End: 52-4569

SEQ ID NO: 172371 - DNA, 8251 bp, Homo sapiens; identical to SEQ ID NO: 171756
  Payload ID: 13891
  Gene Symbol:
  Gene Name: PTPRD
  ENST ID: ENST00000635613
  CDS Start-End: 104-4624

SEQ ID NO: 172372 - DNA, 521 bp, Homo sapiens; identical to SEQ ID NO: 171764
  Payload ID: 13891
  Gene Symbol:
  Gene Name: PTPRD
  ENST ID: ENST00000634771
  CDS Start-End: 243-521

SEQ ID NO: 172373 - DNA, 9911 bp, Homo sapiens; identical to SEQ ID NO: 171758
  Payload ID: 13891
  Gene Symbol:
  Gene Name: PTPRD
  ENST ID: ENST00000634556
  CDS Start-End: 545-6283

SEQ ID NO: 172374 - DNA, 8242 bp, Homo sapiens; identical to SEQ ID NO: 171760
  Payload ID: 13891
  Gene Symbol:
  Gene Name: PTPRD
  ENST ID: ENST00000635611
  CDS Start-End: 107-4615

SEQ ID NO: 172375 - DNA, 8248 bp, Homo sapiens; identical to SEQ ID NO: 171761
  Payload ID: 13891
  Gene Symbol:
  Gene Name: PTPRD
  ENST ID: ENST00000634360
  CDS Start-End: 104-4621

SEQ ID NO: 172376 - DNA, 9472 bp, Homo sapiens; identical to SEQ ID NO: 171757
  Payload ID: 13891
  Gene Symbol:
  Gene Name: PTPRD
  ENST ID: ENST00000634608
  CDS Start-End: 107-5845

SEQ ID NO: 172377 - DNA, 8224 bp, Homo sapiens; identical to SEQ ID NO: 171766
  Payload ID: 13891
  Gene Symbol:
  Gene Name: PTPRD
  ENST ID: ENST00000634498
  CDS Start-End: 107-4597

SEQ ID NO: 172378 - DNA, 6210 bp, Homo sapiens; identical to SEQ ID NO: 171765
  Payload ID: 13891
  Gene Symbol:
  Gene Name: PTPRD
  ENST ID: ENST00000635012
  CDS Start-End: 107-5845

SEQ ID NO: 172379 - DNA, 5039 bp, Homo sapiens; identical to SEQ ID NO: 171762
  Payload ID: 13891
  Gene Symbol:
  Gene Name: PTPRD
  ENST ID: ENST00000634583
  CDS Start-End: 52-4569

SEQ ID NO: 172380 - DNA, 1697 bp, Homo sapiens; identical to SEQ ID NO: 171763
  Payload ID: 13891
  Gene Symbol:
  Gene Name: PTPRD
  ENST ID: ENST00000634307
  CDS Start-End: 816-1424

SEQ ID NO: 172381 - DNA, 5933 bp, Homo sapiens
  Payload ID: 13892
  Gene Symbol: PPFIBP1
  Gene Name: PTPRF interacting protein, binding protein 1 (liprin beta 1)
  Uniprot ID: Q86W92
  ENST ID: ENST00000228425
  CDS Start-End: 234-3251
gactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagatgaaaattttaaaaagaagctcaaagaaaaaaacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagatcgtaaacgaagtgccagtgcacccaccctagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 172382 - DNA, 6001 bp, Homo sapiens
  Payload ID: 13892
  Gene Symbol: PPFIBP1
  Gene Name: PTPRF interacting protein, binding protein 1 (liprin beta 1)
  Uniprot ID: Q86W92
  ENST ID: ENST00000318304
  CDS Start-End: 284-3319
ggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaatctttaatggccaaactttctagcatgaaaatcaaggtgggtcagatgcagtatgaaaagcagcggatggaacaaaaatgggagtcactgaaggatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctca

SEQ ID NO: 172383 - DNA, 559 bp, Homo sapiens
  Payload ID: 13892
  Gene Symbol: PPFIBP1
  Gene Name: PTPRF interacting protein, binding protein 1 (liprin beta 1)
  ENST ID: ENST00000535575
  CDS Start-End: 301-559
ccggctccaatccctggatggctttaagtccagcaaacctttctgtttttcctatcgctcttctctttgcttaacctctcctctttcctccagacccacttaaaagcagttcatcaggaaaacttagctgacagtctcagtcagaactcactcgtgcaggaactttgcaggaagcagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttc

SEQ ID NO: 172384 - DNA, 2805 bp, Homo sapiens
  Payload ID: 13892
  Gene Symbol: PPFIBP1
  Gene Name: PTPRF interacting protein, binding protein 1 (liprin beta 1)
  ENST ID: ENST00000545334
  CDS Start-End: 332-661
ggtacctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatggtagggtctgcctgttccaaattctgttataaatcctttgttgcttattccaaaatttagaacatagaatagctgattagaacaagaaaagtttagggcaacacatgtgctccgattttattacttaagatatcttaattttcttttgactctaaggataactttttaaaaagtgctattagtgtacattttgtaaataccaacaacaggtcacctgattctgcccataaaaacagactggcttttagattgtgcctgaatgacctactgtggcttaaatcaaatagtcctgtaagggaaagaatcttgcacatgatagatgatttctcagtcatattgggttattcaccataaaggatccaatagcaattctaaatggaaagcatgatgaaagactttcaaaaagcaacaggatttacagcagtatttgaccggaagtgccatctagtggtttatggcaatcatttcagttccagttcccgaattaaattgtggagttgggcctttaacccatttatgcgcagtgttccattattggaacgctaagcttgtgggagttatttatatcctgctcaaagtcatcgccaaggtctcatttaaaaaaaaaaaatcacaacctccagcataaatgggttaatggtgttactcactgaacaatgaggccgctttctaggcatccttctcaaaaattgaagatgtggcagagctaccctttgtctgggcacggttggaaatactgtggttttaatctgtgatgaatacataaaatctaaagaatgtcacaaaaacagattcagtggaggacagaggaaaggagatattttgtgcttaaaggatattcaattttcagtaagatgcactcatatgcttatgagttaactgtgttgatataaaagctaataagaattgtatgaaagaatcgtgatctactttatgatctgtggtagacatgaaaaccgcttgctttgggaaccttaagagtacatcctacagctaaaacattttcatatgatgtgacacaaatattagagctcccagccagtcctgtgctgaatactctgtgttcccacctggtttacctctgcgtttctgagagcgaatagtacaatctatcctttagtgggggtgcagctacacaaactggagttattttacttgttaaaacacataatgccttactattatactttctatttgctctacagatttctcctccagagacttaagggtccaggtttgctgatttctttggggattgcttcatgctctgtacttggtgtttcctgacatattccttagtctatttcaatgtcctatctcaccccttctttactccatgttcttctgaccatttagcatgcagtgaaaaaggaatttactattgttagaagaacgtatttctatcccacacccagaggccaccaatggcaatagtagccgaagcgtacctgtagttcagcttttgacatgtgtctaaaacatgtccattaacatgtgcttaatctgttctgtgaaagtattttcagaaatgataaaaagtaatgatggttacatctgaatataagttagatcatgacactcactccttttttcagaaactaccagtggcatcacatcttactcagagtaaaaaccacagtgcttactgtgggctgcaaggcctcgtaggatttgccccccatgactttctgacttcatctcttgtcacacatctccttattcgctccacgccaagcacagtggctttttcactgattcttaaacatgccaggtacactggcctcagagcctttgcactggcttttccaggcactggcttttcactctgcctggaaagctctttcgccagatatttgcatggctagctccctcacattctcctggtgtttactcaaaagtcatgctctcagtgaggccttgtatcaccaccctaactaaaattatacccatttattccttgtcttacatctccctgcttattttgttcttagcattcaccattttcttatgtgcaatgtgtttgtgatgtttatatcatttattttctgtctttccaattggaatgtaagcatcaggaatcagatttttgcccttattttaaaaaaattactgtatccctggtgcttagaagaatgcctggctcagtagttatatttgtaatgaatgatgctccatgaatgataaagtggattgcatgtttgaat

SEQ ID NO: 172385 - DNA, 973 bp, Homo sapiens
  Payload ID: 13892
  Gene Symbol: PPFIBP1
  Gene Name: PTPRF interacting protein, binding protein 1 (liprin beta 1)
  ENST ID: ENST00000539326
  CDS Start-End: 1-728
atgacattggcctccctcaatataagacccagtttgatgaaggacgggttgatggtcgaatgctacattacatgactgttaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatatt

SEQ ID NO: 172386 - DNA, 609 bp, Homo sapiens
  Payload ID: 13892
  Gene Symbol: PPFIBP1
  Gene Name: PTPRF interacting protein, binding protein 1 (liprin beta 1)
  ENST ID: ENST00000538433
  CDS Start-End: 555-609
tgtgtgcattgaaacagcagccttaaggtctttaaacggggaaatacatttttcttgcttcagagattcaattttacttgcccgagaagcttgtgtggtgtgattttcatcgctaaaagcaacagcagccacatggctgacaacaccaccacttaacaattcaaagctcggtcaccgttttcaggagtctcttccaaatctttctgaagtgcttttgaagttctacattccccgtctaagggaacacccagcagtcccaggataaaagggcagaaggtataaaagaacgtgtggatcactttgctgagtacatccaagatttgaagaactgaaataaatcagctttaaacctgctttttaaaaatacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatc

SEQ ID NO: 172387 - DNA, 616 bp, Homo sapiens
  Payload ID: 13892
  Gene Symbol: PPFIBP1
  Gene Name: PTPRF interacting protein, binding protein 1 (liprin beta 1)
  ENST ID: ENST00000537261
  CDS Start-End: 1-616
aatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggacagagctccggcagaaagcaggccatttgggacccttcctcccaggcccccagggcaggacacctccatggatgacaaccccttcggcactcgaaaagtcagatcttcctttggccggggctttttta

SEQ ID NO: 172388 - DNA, 3208 bp, Homo sapiens
  Payload ID: 13892
  Gene Symbol: PPFIBP1
  Gene Name: PTPRF interacting protein, binding protein 1 (liprin beta 1)
  Uniprot ID: Q86W92
  ENST ID: ENST00000542629
  CDS Start-End: 266-3208
agtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttga

SEQ ID NO: 172389 - DNA, 875 bp, Homo sapiens
  Payload ID: 13892
  Gene Symbol: PPFIBP1
  Gene Name: PTPRF interacting protein, binding protein 1 (liprin beta 1)
  Uniprot ID: Q86W92
  ENST ID: ENST00000535047
  CDS Start-End: 270-782
gtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggtatgtgcagaggccagaaccaagatgggatttccctgctgaactatgtgagatgctgcatttctatgttgtgtttgctctgatgcagcagtaagtttcttgattcatttagaccagcacattaaaaaaaaaaaa

SEQ ID NO: 172390 - DNA, 2645 bp, Homo sapiens
  Payload ID: 13892
  Gene Symbol: PPFIBP1
  Gene Name: PTPRF interacting protein, binding protein 1 (liprin beta 1)
  ENST ID: ENST00000540114
  CDS Start-End: 414-2645
gagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatacaaatggacacctaccagggaacggagatgtgtatcaagaaaggctggcacgtttagaaaatgataaagaatccctcgttcttcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaatctttaatggccaaactttctagcatgaaaatcaaggtgggtcagatgcagtatgaaaagcagcggatggaacaaaaatgggagtcactgaaggatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggtaaaaaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttg

SEQ ID NO: 172391 - DNA, 585 bp, Homo sapiens
  Payload ID: 13892
  Gene Symbol: PPFIBP1
  Gene Name: PTPRF interacting protein, binding protein 1 (liprin beta 1)
  ENST ID: ENST00000542187
  CDS Start-End: 129-585
agactggcacttacactatcagccctcctgcttatcaagccttcagactcagactggagctatacccttgggttttctgggtctccagcttgcagttagcagatcttgggacttctcagcctacataaatgcatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagtttt

SEQ ID NO: 172392 - DNA, 5719 bp, Homo sapiens
  Payload ID: 13892
  Gene Symbol: PPFIBP1
  Gene Name: PTPRF interacting protein, binding protein 1 (liprin beta 1)
  Uniprot ID: Q86W92
  ENST ID: ENST00000537927
  CDS Start-End: 462-3038
cagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaatctttaatggccaaactttctagcatgaaaatcaaggtgggtcagatgcagtatgaaaagcagcggatggaacaaaaatgggagtcactgaaggatgaactggcatctttaaaagaacaactagaagaaaaggaatctgaagtaaaaaggctacaagaaaaattggtttgcaagatgaaaggagaaggggttgaaattgttgatagagacatcgaagtacaaaaaatgaaaaaagctgtggagtccttgatggcagcaaatgaagaaaaggatcggaaaatagaagatcttcgacagtgcctgaacaggtacaagaaaatgcaagacacggtggtactggcccaaggcaaagatggagaatatgaagagctgctcaattccagttccatctcctctttgctggatgcacagggtttcagtgatctggagaaaagtccatcacccactccagtaatgggatctcccagttgtgacccatttaacacaagtgttcccgaagagttccatactaccatcttgcaagtttccatcccttcattattgccagcaactgtaagcatggaaacttctgaaaaatcaaagttgactcctaagccagagacttcatttgaagaaaatgatggaaacataatccttggtgccactgttgatacccaactgtgtgataaacttttaacttcaagtctgcagaagtccagcagcctgggcaatctgaagaaagagacatctgatggggaaaaggaaactattcagaagacttcagaggacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttagctgaaacagaaaaagagacagcagagcacctagatctggctggtgcttcttctcggccaaaagattcacagaggaacagtcccttccagataccgcctccatctccagattccaaaaagaaatccagaggtatcatgaaactctttggaaaacttaggagaagtcaatcaactacattcaacccagatgacatgtctgagcctgaattcaaaagaggagggacaagggcaaccgcggggccccgattaggttggtctcgagacttgggacagtctaacagtgacttggatatgccatttgccaagtggaccaaggagcaggtttgcaattggctgatggaacagggcttgggctcgtacctgaattctggcaagcactggattgcatctggccaaacgcttttgcaggcttctcaacaagatctagagaaggaacttggaatcaagcattcacttcatcgaaagaaactccagctagcactccaagccctgggatctgaagaagaaaccaatcatgggaagctggatttcaactgggtcactagatggttggatgacattggcctccctcaatataagacccagtttgatgaaggacgggttgatggtcgaatgctacattacatgactgttgatgacttactgtctctgaaggttgtaagtgtgctacaccatctcagtatcaaaagggccatccaggtcctgaggatcaataactttgaaccaaactgtctacggaggcggccatctgatgagaataccatcgccccatcagaagttcagaagtggactaaccatcgagtgatggagtggctgcgctccgtggacttggcagaatatgcgcccaatctcagaggcagtggtgtccatggtgggctcatggttctagagcctcgttttaacgtagaaacaatggctcagttattgaacatcccacccaataagactttgctgcgaagacatttggccactcatttcaaccttctgattggggctgaggcacagcaccagaagcgagatgccatggagctgccggattatgtacttctaacagctactgccaaagtgaagccaaagaaacttgcctttagcaattttgggaatttgagaaagaagaaacaggaagatggtgaagaatatgtttgtccaatggaattgggacaggcatcaggaagtgcatctaagaaaggatttaaacctggtttggatatgcgcctgtatgaggaagatgatttggaccggttagagcagatggaagattcagaagggacagtgagacagataggtgcattctctgaaggcatcaacaatctgacgcacatgttaaaagaagatgacatgtttaaagattttgctgcccgttcccccagtgccagcattacagatgaagactcaaacgtttgaccgtagcacctggatgaacattaggagtgcttagtcttttttctacttgcttttccaaacactcacagtatatacaacaggcagcggattgtctattgtttgttgttccaacttctgctgtcgagaagtttaaacagaaagcaggagtaatgtgccgattctgaagttgccacaaaaaataagacactggtgaatgagagtataattgtttttcttctatttaatgtaaaaatctgtgatatattatatttaaagtgttgcatttaagatgagtattttaccagagtgtttccattcatatccgcggtatggaggatttgaggaacagtaaccaggatgtgaatgattttgttacatcagtgttcactgtagccacctaagtaggacattatatgatttcagaatcaatatgtggaacttctttaagcattcagtgtgcccactaaatgccagccacacctccacttgcctcttattgtcttatttttatatatttttctaaatatatgtatatatacagtacatagaaaatagaacttttattttgtgacctaaggacgatggtgaaaagatcacgttttcaaaacaatctggtgatcagaatgttcatataccagctggtttctgaagaggtcagaatgatctttctccatactgacttttaacaatgttgatcattgaggctaaattaatatatatgaaatattcctttttgatgacaccacaaaattgttgaacagtttaagaatttcaaccttaatcttggatccctttacctcatatggaagaacttgagggacattagtatacttttttttaagatggagtcttgctctgtcacccaggttggagtgccatggcatgatcttggctcactgcaacctccacctcctgggtcaagccattctgcttcagccccaagtaggtgggactccaggcatgcaccaccatgcctggctaatttttgcatttttagtagagacagggtttcaccatattggccaggctgggactcgaactcctgaccttgtgatctgcccgcctcagcctcccaaagtactgggattataggcatgagccaccacgcccagcctgttatttttttattattattgtttttttttagtgacagagtctcattctgttgcccatgctggagtgcagtggcgtgatcatagctcactgcagccttgaattcctaggctccagtgatcctctcacctcagcttccctaatagctaggattacaggtgtgtggcctcccaccccaccccacccttcacacctggctgatttttcaaaaagtttttttgtagaaacagggtctcaccatgttgtccagcctggtctcaaactcctgtcctcaagtgatcctcccacctcagcctttcaaagtgctggaattacaggtgtgagccactctgcctggcctaccactaacttgaatacattcagaatcacctcctctccccaaaatttgtagaaatagtttttgaggaagccaaaagcaaagcagaaacctttacagtattgtttcttttctctttgttaactgtgtcattacagcaaaatactagcagtctgcctaaacatgttcattgtacatttctcaggctatcaatgaatggaggtttttaaaaagttgaatatttgtctgaacattttatttcaaagttcaaaaaaacagaggctgcaaaattcattttataatggctattttgtgacgataagatgtagttcatgtttttctgtagcactgggcccaaatattctttgtaaagaaaatcgctgcagcaaaaactgttactgtgtttattatatttgtagaagtattagaaaaatattctattttttattcagtgctgcgtaattacccatggtagccaaccctacaaaagacaggttttcacaaattgaggtggaggtgggcggttcagtatctgccactggacttgattataaactgtatttgaatatcagtggtattatcttttaagttgtcagcaagttaccaaggtattcattaaagaacttgtaatatcaaattactatttattcataacaattgatttgatgctaataataattttctttaaactctaccattcattatgtggtaactgtattgaacttactttatttggattttattttaatgtgactagatgtcaccacttcaaaaaatcaatttgttcttagaacctggttgaaaataccaggaaactgttacagacgccattttttttttttttgagacggagtcttgctctgttgcccaggctggagtgcagtggcacaatctcagctcactgcaagctccgcctcctgggttcacgccattctcccacctcagcttcccaagcagctgggactacaggtacctgccaccacgcctggctaattttgtttttgtatttttagtagagacggggtttcaccgtgttagccaggaaggtctcaatctcctgacctcgtgaatcgcccccctcggtctcccaaagtgctgggattacaggcgtgagccaccatgcccggcccaaatattttttattcaggatggtataacctaactgataataggtaataaggttaaatttttttatgacgtattttatttacaaatatcatacactgctggtgttaccatatgaaaggaaataaagtcaattgataattgcctc

SEQ ID NO: 172393 - DNA, 1191 bp, Homo sapiens
  Payload ID: 13892
  Gene Symbol: PPFIBP1
  Gene Name: PTPRF interacting protein, binding protein 1 (liprin beta 1)
  ENST ID: ENST00000545381
  CDS Start-End: 348-1191
ggcagtgggagggggaggtacctggaactgggagtgatgtcagctcccagctcggtgcctgcccggattcctgacatggtgtagtgcaggcagggtggggaaaggacggggaaggactcgtgtgctgcgagctggcggccgggccggagtgctggggctttgaactccgagaggaggtggaccagaacttttggaactagtgccggcggctctccaccccccagtataaaagaacgtgtggatcactttgctgagtacatccaagatttgaagaactgaaataaatcagctttaaacctgctttttaaaaatatctgggttggaatttgcccctgacaaataataaaatgatgagtgatgcaagtgacatgttggctgcagcgttggagcagatggatggtatcatagcaggttctaaggctctggaatattccaatgggatttttgattgccaatctcccacctctccattcatgggaagtttgcgagctctgcaccttgtggaagacctgcgtggattgttagagatgatggaaacagatgagaaagaaggcttgagatgccagatcccagattcaacagcagaaacgcttgttgaatggcttcagagtcaaatgacaaatggacacctaccagggaacggagatgtgtatcaagaaaggctggcacgtttagaaaatgataaagaatccctcgttcttcaggtaagtgtgttaacagaccaggtggaggctcagggagagaagattcgagatttggagttttgtcttgaagagcacagagagaaggtgaatgccacagaagaaatgctgcagcaggagcttctaagtaggacatccttagaaactcagaagttggatctgatggctgaaatatctaacttgaagttgaaactgacagctgtagagaaggacagattggattatgaagataagttcagagacacagaggggctgattcaggagatcaatgatttgaggttaaaagttagtgaaatggacagtgagagacttcagtatgaaaaaaagcttaaatcaaccaaagatgaactggcatctttaaaagaacaactagaagaaaaggaatctgaagtaaaaaggctacaagaaaaattggtttgcaagatgaaaggagaaggggttgaaattgttgatagagatgaaaattttaaaaagaagctcaaagaaaaaa

SEQ ID NO: 172394 - DNA, 1565 bp, Homo sapiens
  Payload ID: 13892
  Gene Symbol: PPFIBP1
  Gene Name: PTPRF interacting protein, binding protein 1 (liprin beta 1)
  ENST ID: ENST00000619325
  CDS Start-End: 1-261
gacagagctccggcagaaagcaggccatttgggacccttcctcccaggcccccagggcaggacacctccatggatgacaaccccttcggcactcgaaaagtcagatcttcctttggccggggcttttttaaaatcaaaagtaacaagagaacagcaagtgcaccaaacttaggtacgtatgaccaaaatgcctttgccctaattcttccacaaggaggaaaagagcagtgtcttcccttcccttactctttcattcattgattcatttctctttctcagaaacgaaggtgaatgacttaggggaatttagcaaaaaatgcctccgtggatttaatttagtgttgtgaagatatatagactctcaccctgctctctcctgtggtataaacttagcggaaagacctaaaatcatgattccctttgacttcatcatggagtttcccatctgttgtgatagtggataaattaacattgacgttgagcctgtgtgtaacatcagaagcactgtgtgccgcatgcctctcctccacggtgtgtatttggcgaggaggagtctgatctgcatttcattttgtcatctctgtgttctctccattgggctgcgtgtgattgtgtgcgttgttgggatatctgaagatcgtaaacgaagtgccagtgcacccaccctaggtattgtacccctgcatgccagccttcaccagcactgtgctccaaaccaatctaatccctgctcttggcatctgtgatctctagaaagcgatctgacagcaatcagaaaatgtagttctctattccggagtgttctttccaccttctgctaaaaaggactctgtagaggctttgcttccaagcctaaatgctgttttaaccaatactagtaacactcactgtgtgaatagctttgagaggacctagacgtgtgcagcatccctcagagtgcagggcaggaatgtcctggcattgtacattgcagctctttcagccttgaagtgcatattaccacacactaactcccaggtccttgcagtccgttctccatgcttacatttcccccagcctccaaaaagaaatttttttggccatatagggaggtttatagaagacattgaatattatagttttaggcttacttctcttaggggaacattcttctgacgttttattactttgaagatggagataatatttagtgatgacagaagcaactttacttgatatctgaggcgttaccccccaaagtgattttagaagaggggcagctcagttttcctctttgtaaggcaggggacaaatggggaaaaaagttctcaaaataaaaaagagaaatatggtagttttaagatgaggataagctaggcagcattttcaggggcacctgtagccatcgtggttgaaggatttgaattgggaaagttcctttgggtttttccaaaaggtgctgttaccttgtatagatatccacctatctattcacatggaccagcaaacgggacttctctctctatcgatataaatgtctagaatgaacactggatgcataaaataaactgatctgttcagacaac

SEQ ID NO: 172395 - DNA, 3557 bp, Homo sapiens
  Payload ID: 13893
  Gene Symbol: PPFIBP2
  Gene Name: PTPRF interacting protein, binding protein 2 (liprin beta 2)
  Uniprot ID: Q8ND30
  ENST ID: ENST00000299492
  CDS Start-End: 389-3019
gctgaccaggccggtcccccgggaacaggaaccctggtggacgggtcccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacagacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaa

SEQ ID NO: 172396 - DNA, 814 bp, Homo sapiens
  Payload ID: 13893
  Gene Symbol: PPFIBP2
  Gene Name: PTPRF interacting protein, binding protein 2 (liprin beta 2)
  ENST ID: ENST00000528947
  CDS Start-End: 547-814
gggctgaccaggccggtcccccgggaacaggaaccctggtggacgggtcccagcaggcttcttcggtgcccgagagggagcgggtgcccaagggggtggtccctgtggcaggtcccggggtgggggcgcggcgctccgggaagagccttccgcaggtccccgccccgtcacgtgggcgccggccccggccgctgcggtcggtccgctggttggtcgggcgcttggtccggcagttggtcggtgggccagtggcccgtcgctcgcttctgggctctcatgtttgaaggtgggagggacacgggagcggcccgcacacctgagccgcccggagaggagcctcggccccgtacccaggaaaaactggcggagagcctcagaaccacctgtttcctctgctgcaccatgcttgagtgtggaagccgtgcccctgttctccacagcgtgtatggccattcggcacatgtgtagatttgctgaatgagcaaacagcaactcctccagtttacagactaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttg

SEQ ID NO: 172397 - DNA, 534 bp, Homo sapiens
  Payload ID: 13893
  Gene Symbol: PPFIBP2
  Gene Name: PTPRF interacting protein, binding protein 2 (liprin beta 2)
  ENST ID: ENST00000526046
  CDS Start-End: 325-534
attcagcaactctgatagcaacgttctcagcagcctggcccctctgtcctgctatggctcctctttgtcctgacaggatatctcgctgtgttgggctcctctgtcctgagggaaatttagcacaatggccttgtccctcattgtgatataaagccagtgtctgtgggctctgccattgctctgaggagctgtcttcgcaggccaggtgtgcggcttctcctctccactgtcagatctgatcctgtgggggtcgtgacctctggatgttataggacctgtggaggacagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagaga

SEQ ID NO: 172398 - DNA, 673 bp, Homo sapiens
  Payload ID: 13893
  Gene Symbol: PPFIBP2
  Gene Name: PTPRF interacting protein, binding protein 2 (liprin beta 2)
  ENST ID: ENST00000534409
  CDS Start-End: 1-673
agggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgaatcgtggccggagtgtcagtgcccccgtattaggagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgca

SEQ ID NO: 172399 - DNA, 577 bp, Homo sapiens
  Payload ID: 13893
  Gene Symbol: PPFIBP2
  Gene Name: PTPRF interacting protein, binding protein 2 (liprin beta 2)
  ENST ID: ENST00000525597
  CDS Start-End: 318-577
gtaaatgcagagtgaagcagagacaggaaatcggggctctcagtaatgagttccagccactccagaagggggaagccagacaaggaattttcttcaggactgtttccctctggcaggctccgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaaga

SEQ ID NO: 172400 - DNA, 407 bp, Homo sapiens
  Payload ID: 13893
  Gene Symbol: PPFIBP2
  Gene Name: PTPRF interacting protein, binding protein 2 (liprin beta 2)
  ENST ID: ENST00000524548
  CDS Start-End: 1-407
accccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacagatatgcaatttagtcctcagattttgtatgcttaatattatatttttcccatttaaa

SEQ ID NO: 172401 - DNA, 484 bp, Homo sapiens
  Payload ID: 13893
  Gene Symbol: PPFIBP2
  Gene Name: PTPRF interacting protein, binding protein 2 (liprin beta 2)
  ENST ID: ENST00000526873
  CDS Start-End: 217-484
actagagggacctccaccccaggttgcgagtgcagcgcggcgggacctgggatgattcgggggctttccgacctgcttagggagggcggctcagagacaacctcaattttgcctggattgcacgcgggccgaggaagtcgggatgctccgaagggtttctgctctgggagtgcctctaattaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttg

SEQ ID NO: 172402 - DNA, 625 bp, Homo sapiens
  Payload ID: 13893
  Gene Symbol: PPFIBP2
  Gene Name: PTPRF interacting protein, binding protein 2 (liprin beta 2)
  ENST ID: ENST00000527790
  CDS Start-End: 114-625
cagtaggaggaggatgtcgctgctgagactgtgggacagctaggctcagagggagtctgacttcggggcacccggagtaagaagaggaggaggccaggcaggcaaaaggagtcatggcttctgatgctagtcatgcgctggaagctgccctggagcaaatggacgggatcattgcaggcactaaaacaggtgcagatcttagtgatggtacttgtgagcctggactggcttccccggcctcctacatgaaccccttcccggtgctccatctcatcgaggacttgaggctggccttggagatgctggagcttcctcaggagagagcagccctcctgagccagatccctggcccaacagctgcctacataaaggaatggtttgaagagagcttgtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttga

SEQ ID NO: 172403 - DNA, 2580 bp, Homo sapiens
  Payload ID: 13893
  Gene Symbol: PPFIBP2
  Gene Name: PTPRF interacting protein, binding protein 2 (liprin beta 2)
  Uniprot ID: Q8ND30
  ENST ID: ENST00000528883
  CDS Start-End: 153-2447
gttgcagaagtgctggcaagccagctgagatgtgccttgaggtcggggctgttctggaagaggaataaggagcaggagtccagcccagaggcagctcctgtggctgttgggtgttttactcttgagtctatcaagagcagtaaacgtgacccatgtcatcagagcagtggccgagactccctggtaaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacagacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctggg

SEQ ID NO: 172404 - DNA, 780 bp, Homo sapiens
  Payload ID: 13893
  Gene Symbol: PPFIBP2
  Gene Name: PTPRF interacting protein, binding protein 2 (liprin beta 2)
  ENST ID: ENST00000529575
  CDS Start-End: 314-780
agtttacagttctgcctgataagatgctgctgatttctggtaggcagcaggagtaacacctcagggggcctcagctcctttttcagccattccctcaagtacttggaattccagccagtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaa

SEQ ID NO: 172405 - DNA, 562 bp, Homo sapiens
  Payload ID: 13893
  Gene Symbol: PPFIBP2
  Gene Name: PTPRF interacting protein, binding protein 2 (liprin beta 2)
  ENST ID: ENST00000534552
  CDS Start-End: 1-448
aaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaa

SEQ ID NO: 172406 - DNA, 3003 bp, Homo sapiens
  Payload ID: 13893
  Gene Symbol: PPFIBP2
  Gene Name: PTPRF interacting protein, binding protein 2 (liprin beta 2)
  ENST ID: ENST00000533792
  CDS Start-End: 305-2461
gatgggaataggaggaggtggggggtggcatctagggagtgctggaggggccacctggagagcctgcatgtgacctgccctgaaaggaggaaaacagctgcagctccagtcccaggtaaaccaccacagtgctgctagtaatgaaacctaccaggaacgcttggcacgtctagaaggggataaggagtccctcatattgcaggtgagtgtcctcacagaccaagtagaagcccagggagaaaagattcgagacctggaagtgtgtctggaaggacaccaggtgaaactcaatgctgctgaagagatgcttcaacaggagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacagacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaa

SEQ ID NO: 172407 - DNA, 545 bp, Homo sapiens
  Payload ID: 13893
  Gene Symbol: PPFIBP2
  Gene Name: PTPRF interacting protein, binding protein 2 (liprin beta 2)
  ENST ID: ENST00000530081
  CDS Start-End: 1-545
atgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgaatcgtggccggagtgtcagtgcccccgtattaggtactgtacccattccaggagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggg

SEQ ID NO: 172408 - DNA, 2965 bp, Homo sapiens
  Payload ID: 13893
  Gene Symbol: PPFIBP2
  Gene Name: PTPRF interacting protein, binding protein 2 (liprin beta 2)
  Uniprot ID: Q8ND30
  ENST ID: ENST00000530181
  CDS Start-End: 222-2423
aagaaattagaggttgagtgagcaagtgggacagatgaaaggtcagaagattgtggccagaggagagaatttcagagctgaagattttagaagcaaagcaaacacattctggatacacgtgagatccaagtggtgactgtgctactgagaagctgaacgaaatggaaagcaaagcctgttggagctgaggtcaaagaatgtgaagccagagtggatactgaatgggaaagttaataacaaggatgtggaagctattgaggagacggagtgcgcctaaagagctgctaagccgcacatctcttgagacccagaagctcgatctgatgactgaagtgtctgagctgaagctcaagctggttggcatggagaaggagcagagagagcaggaggagaagcagagaaaagcagaggagttactgcaagagctcaggcacctcaaaatcaaagtggaagagttggaaaatgaaaggaatcagtatgaatggaagctaaaggccactaaggctgaagtcgcccagctgcaagaacaggtggccctgaaagatgcagaaattgagcgtctgcacagccagctctcccggacagcagctctccacagtgagagtcacacagagagagaccaagaaattcaacgtctgaaaatggggatggaaactttgctgcttgccaatgaagataaggaccgtcggatagaggagcttacggggctgttaaaccagtaccggaaggtaaaggagattgtgatggtcactcaagggccttcggagagaactctctcaatcaatgaagaagaaccggagggaggtttcagcaagtggaacgctacaaataaggaccctgaagaattatttaaacaagagatgcctccaagatgtagctctcctacagtggggccacctccattgccacagaaatcactggaaaccagggctcagaaaaagctctcttgtagtctagaagacttgagaagtgaatctgtggataagtgtatggatgggaaccagcccttcccggtgttagaacccaaggacagccctttcttggcggagcacaaatatcccactttacctgggaagctttcaggagccacgcccaatggagaggctgccaaatctcctcccaccatctgccagcctgacgccacggggagcagcctgctgaggctgagagacacagaaagtggctgggacgacactgctgtggtcaatgacctctcatccacatcatcgggcactgaatcaggtcctcagtctcctctgacaccagatggtaaacggaatcccaaaggcattaagaagttctggggaaaaatccgaagaactcagtcaggaaatttctacactgacacgctggggatggcagagtttcgacgaggtgggctccgggcaaccgcagggccaagactctctaggaccagggactccaagggacagaaaagtgacgccaatgccccctttgcccagtggagcacagagcgtgtgtgtgcatggctggaggactttggcctggctcagtatgtgatctttgccaggcagtgggtatcttctggccacaccttattgacagccacccctcaggacatggaaaaggagctaggaattaagcacccactccacaggaagaagcttgttttagcagtgaaagccatcaacaccaaacaggaggagaagtctgcactgctagaccacatttgggtgacaaggtggcttgatgatattggcttaccccagtacaaagaccagtttcatgaatctagagttgacagacgaatgctgcaatacctaactgtgaacgatttactcttcttaaaagtcaccagccaactacatcatctcagcatcaaatgtgccattcacgtgctgcatgtcaacaagttcaacccccactgcctgcaccggcggccagctgatgagagtaacctttctccttcagaagttgtacagtggtccaaccacagggtgatggagtggttacgatctgtggacctggcagagtatgcacccaatcttcgagggagtggagtccatggaggcctcattatcctggagccacgcttcactggggacaccctggctatgcttctcaacatccccccacaaaagacgctcctcaggcgccacctgaccaccaagttcaatgccttgattggtccggaggctgaacaggagaagcgagagaaaatggcctcaccagcttacacaccactgaccaccacagccaaagtccggccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaa

SEQ ID NO: 172409 - DNA, 5360 bp, Homo sapiens
  Payload ID: 13894
  Gene Symbol: PUM1
  Gene Name: pumilio RNA-binding family member 1
  Uniprot ID: Q14671
  ENST ID: ENST00000257075
  CDS Start-End: 95-3655
ggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctg

SEQ ID NO: 172410 - DNA, 4242 bp, Homo sapiens
  Payload ID: 13894
  Gene Symbol: PUM1
  Gene Name: pumilio RNA-binding family member 1
  ENST ID: ENST00000373741
  CDS Start-End: 207-3881
aaccccgcgtgcccagctccaggccgtgttctcccaggtgcgggccggcgggaccccgccttcggccctggcggcgcgcgctcgcctagcgggcgggcactcgcgcgcagcgtttgtgttgcctgcgagtttcccgagttcacacaggccctgggttggcatggcaaccaggcaacctgttccagagccgccagccttctccgcacatgccgctgccaccgccggggccggggccggagcctatcccaggatgcaccgcgccaacccagtccccagtgggccgccatgttgtcggagtgaaaggtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcaggtaattaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaa

SEQ ID NO: 172411 - DNA, 3515 bp, Homo sapiens
  Payload ID: 13894
  Gene Symbol: PUM1
  Gene Name: pumilio RNA-binding family member 1
  Uniprot ID: Q14671
  ENST ID: ENST00000373742
  CDS Start-End: 1-3384
atgccgctgccaccgccggggccggggccggagcctatcccaggatgcaccgcgccaacccagtccccagtgggccgccatgttgtcggagtgaaaggtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcgcaggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcct

SEQ ID NO: 172412 - DNA, 5375 bp, Homo sapiens
  Payload ID: 13894
  Gene Symbol: PUM1
  Gene Name: pumilio RNA-binding family member 1
  ENST ID: ENST00000373747
  CDS Start-End: 101-3670
gttgtcggagtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcgcaggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcaggtaattaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctg

SEQ ID NO: 172413 - DNA, 4043 bp, Homo sapiens
  Payload ID: 13894
  Gene Symbol: PUM1
  Gene Name: pumilio RNA-binding family member 1
  Uniprot ID: Q14671
  ENST ID: ENST00000426105
  CDS Start-End: 92-3658
gtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcaggtaattaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaa

SEQ ID NO: 172414 - DNA, 4631 bp, Homo sapiens
  Payload ID: 13894
  Gene Symbol: PUM1
  Gene Name: pumilio RNA-binding family member 1
  ENST ID: ENST00000424085
  CDS Start-End: 92-2926
gtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagctgttccaaagacctaatgcgcttgctgtccagcagttgacagctgctcagcagcagcagtatgcactggcagctgctcatcagccgcacatcggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaaggaataaatgttctttatacagcctagttaatgtttaaaaagaaaaaaatagcttggttttatttgtcatctagtctcaagtatagcgagattctttctaaatgttattcaagattgagttctcactagtgtttttttaatcctaaaaaagtaatgttttgattttgtgacagtcaaaaggacgtgcaaaagtctagccttgcccgagctttccttacaatcagagcccctctcaccttgtaaagtgtgaatcgcccttcccttttgtacagaagatgaactgtattttgcattttgtctacttgtaagtgaatgtaacatactgtcaattttccttgtttgaatatagaattgtaacactacacggtgtacatttccagagccttgtgtatatttccaatgaacttttttgcaagcacacttgtaaccatatgtgtataattaacaaacctgtgtatgcttatgcctgggcaactattttttgtaactcttgtgtagattgtctctaaacaatgtgtgatctttattttgaaaaatacagaactttggaatctg

SEQ ID NO: 172415 - DNA, 3936 bp, Homo sapiens
  Payload ID: 13894
  Gene Symbol: PUM1
  Gene Name: pumilio RNA-binding family member 1
  Uniprot ID: Q14671
  ENST ID: ENST00000440538
  CDS Start-End: 81-3569
gggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcgcaggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcaggtaattaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagcttt

SEQ ID NO: 172416 - DNA, 683 bp, Homo sapiens
  Payload ID: 13894
  Gene Symbol: PUM1
  Gene Name: pumilio RNA-binding family member 1
  ENST ID: ENST00000529846
  CDS Start-End: 1-683
gctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcaggtaattaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaa

SEQ ID NO: 172417 - DNA, 549 bp, Homo sapiens
  Payload ID: 13894
  Gene Symbol: PUM1
  Gene Name: pumilio RNA-binding family member 1
  ENST ID: ENST00000531867
  CDS Start-End: 262-549
cactctgtcgcccaagcgggtgtgcagcctcccgctcctgggctcaaatgatcctcccacctcagcctccctagtagctgggactataggcacatgccaccatgcctggctaattatttttagtagagataggtcttgctatgttgcccaggctggtcttgaactcctgggctcaagctgtctgcccacctcagcctcccaaagtgctgggattgtaggtatgagccaccacacccaactgaggcttctggtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggagga

SEQ ID NO: 172418 - DNA, 652 bp, Homo sapiens
  Payload ID: 13894
  Gene Symbol: PUM1
  Gene Name: pumilio RNA-binding family member 1
  ENST ID: ENST00000527498
  CDS Start-End: 1-273
tccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcaggtaattaatgagatggttcgggaactagatggccatgtcttgaagtgtgtgaaagatcagaatggcaatcacgtggttcagaaatgcat

SEQ ID NO: 172419 - DNA, 1103 bp, Homo sapiens
  Payload ID: 13894
  Gene Symbol: PUM1
  Gene Name: pumilio RNA-binding family member 1
  ENST ID: ENST00000525948
  CDS Start-End: 92-376
gtgaaaggtaagggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtg

SEQ ID NO: 172420 - DNA, 650 bp, Homo sapiens
  Payload ID: 13894
  Gene Symbol: PUM1
  Gene Name: pumilio RNA-binding family member 1
  ENST ID: ENST00000525997
  CDS Start-End: 1-650
tggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatg

SEQ ID NO: 172421 - DNA, 3068 bp, Homo sapiens
  Payload ID: 13894
  Gene Symbol: PUM1
  Gene Name: pumilio RNA-binding family member 1
  ENST ID: ENST00000498419
  CDS Start-End: 1-2701
ttttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggtatgttttcagcaggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcagttgcaaactccaacactggcagtggctcccgccgtgactccctgactggcagcagtgacctttataagaggacatcgagcagcttgacccccattggacacagtttttataacggccttagcttttcctcctctcctggacccgtgggcatgcctctccctagtcagggaccaggacattcacagacaccacctccttccctctcttcacatggatcctcttcaagcttaaacctgggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcaggtaattaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagcttt

SEQ ID NO: 172422 - DNA, 582 bp, Homo sapiens
  Payload ID: 13894
  Gene Symbol: PUM1
  Gene Name: pumilio RNA-binding family member 1
  ENST ID: ENST00000530669
  CDS Start-End: 1-231
tttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggtagtggagttgccagtagaggaactgcgaacacctgtgggcttgtgcagggccagagtttgtgtgttttgtcagtgatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacaccta

SEQ ID NO: 172423 - DNA, 793 bp, Homo sapiens
  Payload ID: 13894
  Gene Symbol: PUM1
  Gene Name: pumilio RNA-binding family member 1
  ENST ID: ENST00000532678
  CDS Start-End: 1-793
caatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagct

SEQ ID NO: 172424 - DNA, 4528 bp, Homo sapiens
  Payload ID: 13894
  Gene Symbol: PUM1
  Gene Name: pumilio RNA-binding family member 1
  ENST ID: ENST00000525843
  CDS Start-End: 1-3376
ccagtccccagtgggccgccatgttgtcggagtgaaaggtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttagccgtacccctggtaattgccagaactctgctaatgaagtggatcttctgggtccaaaccagaatggttctgagggcttagcccagctgaccagcaccaatggtgccaagcctgtggaggatttctccaacatggagtcccagagtgtccccttggaccccatggaacatgtgggcatggagcctcttcagtttgattattcaggcacgcaggtacctgtggactcagcagcagcaactgtgggactttttgactacaattctcaacaacagctgttccaaagacctaatgcgcttgctgtccagcagttgacagctgctcagcagcagcagtatgcactggcagctgctcatcagccgcacatcgcaggtttagctcccgctgcgtttgtccccaatccatacatcatcagcgctgctcccccagggacggacccctacacagctggattggctgcagcagcgacactaggcccagctgtggtccctcaccagtattatggagttactccctggggagtctaccctgccagtcttttccagcagcaagctgccgctgccgctgcagcaactaattcagctaatcaacagaccaccccacaggctcagcaaggacagcagcaggttctccgtggaggagccagccaacgtcctttgaccccaaaccagaaccagcagggacagcaaacggatccccttgtggcagctgcagcagtgaattctgcccttgcatttggacaaggtctggcagcaggcatgccaggttatccggtgttggctcctgctgcttactatgaccaaactggtgcccttgtagtgaatgcaggcgcgagaaatggtcttggagctcctgttcgacttgtagctcctgccccagtcatcattagttcctcagctgcacaagcagctgttgcagcagccgcagcttcagcaaatggagcagctggtggtcttgctggaacaacaaatggaccatttcgccctttaggaacacagcagcctcagccccagccccagcagcagcccaataacaacctggcatccagttctttctacggcaacaactctctgaacagcaattcacagagcagctccctcttctcccagggctctgcccagcctgccaacacatccttgggattcggaagtagcagttctctcggcgccaccctgggatccgcccttggagggtttggaacagcaggaggactcacgaatggcagtggaagatacatctctgctgctccaggcgctgaagccaagtaccgcagtgcaagcagcgcctccagcctcttcagcccgagcagcactcttttctcttcctctcgtttgcgatatggaatgtctgatgtcatgccttctggcaggagcaggcttttggaagattttcgaaacaaccggtaccccaatttacaactgcgggagattgctggacatataatggaattttcccaagaccagcatgggtccagattcattcagctgaaactggagcgtgccacaccagctgagcgccagcttgtcttcaatgaaatcctccaggctgcctaccaactcatggtggatgtgtttggtaattacgtcattcagaagttctttgaatttggcagtcttgaacagaagctggctttggcagaacggattcgaggccacgtcctgtcattggcactacagatgtatggctgccgtgttatccagaaagctcttgagtttattccttcagaccagcagaatgagatggttcgggaactagatggccatgtcttgaagtgtgtgaaagatcagaatggcaatcacgtggttcagaaatgcattgaatgtgtacagccccagtctttgcaatttatcatcgatgcgtttaagggacaggtatttgccttatccacacatccttatggctgccgagtgattcagagaatcctggagcactgtctccctgaccagacactccctattttagaggagcttcaccagcacacagagcagcttgtacaggatcaatatggaaattatgtaatccaacatgtactggagcacggtcgtcctgaggataaaagcaaaattgtagcagaaatccgaggcaatgtacttgtattgagtcagcacaaatttgcaagcaatgttgtggagaagtgtgttactcacgcctcacgtacggagcgcgctgtgctcatcgatgaggtgtgcaccatgaacgacggtccccacagtgccttatacaccatgatgaaggaccagtatgccaactacgtggtccagaagatgattgacgtggcggagccaggccagcggaagatcgtcatgcataagatccggccccacatcgcaactcttcgtaagtacacctatggcaagcacattctggccaagctggagaagtactacatgaagaacggtgttgacttagggcccatctgtggcccccctaatggtatcatctgaggcagtgtcacccgctgttccctcattcccgctgacctcactggcccactggcaaatccaaccagcaaccagaaatgttctagtgtagagtctgagacgggcaagtggttgctccaggattactccctcctccaaaaaaggaatcaaatccacgagtggaaaagcctttgtaaatttaattttattacacataacatgtactattttttttaattgactaattgccctgctgttttactggtgtataggatacttgtacataggtaaccaatgtacatgggaggccacatattttgttcactgttgtatctatatttcacatgtggaaactttcagggtggttggtttaacaaaaaaaaaaagctttaaaaaaaaaagaaaaaaaggaaaaggtttttagctcatttgcctggccggcaagttttgcaaatagctcttccccacctcctcattttagtaaaaaacaaacaaaaacaaaaaaacctgagaagtttgaattgtagttaaatgaccccaaactggcatttaacactgtttataaaaaatatatatatatatatatatatatataatgaaaaaggtttcagagttgctaaagcttcagtttgtgacattaagtttatgaaattctaaaaaatgccttttttggagactatattatgctgaagaaggctgttcgtgaggaggagatgcgagcacccagaacgtcttttgaggctgggcgggtgtgattgtttactgcctactggatttttttctattaacattgaaaggtaaaatctgattatttagcatgagaaaaaaaaatccaactctgcttttggtcttgcttctataaatatatagtgtatacttggtgtagactttgcatatatacaaatttgtagtattttcttgttttgatgtctaatctgtatctataatgtaccctagtagtcgaacatacttttgattgtacaattgtacatttgtatacctgtaatgtaaatgtggagaagtttgaatcaacataaacacgttttttggtaagaaaagagaattagccagccctgtgcattcagtgtatattctcaccttttatggtcgtagcatatagtgttgtatattgtaaattgtaatttcaaccagaagtaaatttttttcttttgaagg

SEQ ID NO: 172425 - DNA, 586 bp, Homo sapiens
  Payload ID: 13894
  Gene Symbol: PUM1
  Gene Name: pumilio RNA-binding family member 1
  ENST ID: ENST00000526215
  CDS Start-End: 73-357
gagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagctgttccaaagacctaatgcgcttgctgtccagcagttgacagctgctcagcagcagcagtatgcact

SEQ ID NO: 172426 - DNA, 906 bp, Homo sapiens
  Payload ID: 13894
  Gene Symbol: PUM1
  Gene Name: pumilio RNA-binding family member 1
  ENST ID: ENST00000480602
  CDS Start-End: 80-454
ggggagcgagagcgccagagagagaagatcggggggctgaaatccatcttcatcctaccgctccgcccgtgttggtggaatgagcgttgcatgtgtcttgaagagaaaagcagtgctttggcaggactctttcagcccccacctgaaacatcaccctcaagaaccagctaatcccaacatgcctgttgttttgacatctggaacagggtcgcaagcgcagccacaaccagctgcaaatcaggctcttgcagctgggactcactccagccctgtcccaggatctataggagttgcaggccgttcccaggacgacgctatggtggactacttctttcagaggcagcatggtgagcagcttgggggaggaggaagtggaggaggcggctataataatagcaaacatcgatggcctactggggataacattcatgcagaacatcaggaggtattatgaaactttcgtgttgattgaatgagggaagacgagaggttcttcagttttgcgctcaggtgcgttccatggatgaactgaatcatgattttcaagcacttgctctggagggaagagcgatgggagagcagctcttgccaggtaaaaagttttgggaaacagatgaatccagcaaagatggaccaaaaggaatattcctgggtgatcaatggcgagacagtgcctggggaacatcagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttggcccaagggatgcagacagtgatgaaaacgacaaaggt

SEQ ID NO: 172427 - DNA, 6002 bp, Homo sapiens
  Payload ID: 13895
  Gene Symbol: PUM2
  Gene Name: pumilio RNA-binding family member 2
  ENST ID: ENST00000319801
  CDS Start-End: 320-3109
ttcaacaggtttgatctgtggatgaaatgaatcatgattttcaagctcttgcattagaatctcggggaatgggagagatgcagaaaagagtccaagtctctcctttgggccacaagagggcaccctgcagctagctaaccctccccttcttcagaacagcgttttccaaagagtatgtcattttcagaggactgatttaaggcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaatacccctctgtacctc

SEQ ID NO: 172428 - DNA, 6112 bp, Homo sapiens
  Payload ID: 13895
  Gene Symbol: PUM2
  Gene Name: pumilio RNA-binding family member 2
  Uniprot ID: Q8TB72
  ENST ID: ENST00000338086
  CDS Start-End: 24-3218
aacaggtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaatacccctctgtacctca

SEQ ID NO: 172429 - DNA, 6251 bp, Homo sapiens
  Payload ID: 13895
  Gene Symbol: PUM2
  Gene Name: pumilio RNA-binding family member 2
  Uniprot ID: Q8TB72
  ENST ID: ENST00000361078
  CDS Start-End: 332-3358
ggggggaggggagggcaggcggcggtggcagccatgttgttgtgagtctctgtgtctcaccctcggtacttcggtggttcggaggaggagggggaggagaaggaggaggtggggtggggggggagggtggtaggtggagaaagaagacattgccgccaccgaaggcggaggagggggaggaccgccaagagcgacgccgccgtgtgcccaacggtcggtgtccccggctgaggcagcgcggccgcagcagccctgtttgatctgtggatgaaatgaatcatgattttcaagctcttgcattagaatctcggggaatgggagagaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctttgcctatgaaaatattttggaaaaaaacttgctgtgtatattcagtttctgaaagataaagaaagtgctttgtattttgttgaagtcagtattttgtataaacatttatgttgacccacttatgttcagtgctgaaaactaaaatgaacatgctattctgtcagctgaatatggaagagatctttttttactagagatctgcagaagaaacgcaatcttctgagcacaatatggaatctaaaggttttatcacttagttgttcatattatgaacctaaaaataatggcataaagtttggggatgccaggcatactttttcatgtttggtgttgagttattttacttttctaacccaacattccttggtgagaccattaaatccaaacacttgtcaccgttccttctcatagtcactctgggtcatcagcatgtcccagtcactgcagcaacgccttgtgtttgtttcatttttttaaaacccacacaaagccgctgtctcactttttcctactttaccaacctcagagtatttcggcccgtatcgaacttttgttctcagtatcagcccatggtttcaggatcaaagctgtcatgttggagattggtaatggctttcctgtctttgtacagttgaattcctagtcttccttcatccttgccctctgttggcacaggcattatctctgcaattttagaaaatgacaagtagagaatactacattgagaaactaaaccctcttcttggggtcctgatactcattcccatttgtcccagtgctgacaacccaatcttcccaatactttcaggcctgctctacaaaagtacctgttcttgtagaaattttacagtctgccattttgggtgcccaccccaatttttaccttttagtaagttggcatgaaattttggtaaaatctgaaaatcacatttcagaataaaacaattgggcaaaactacctaggctttactcttgagtgtctccttttgatagggattgtttctggaccagtttgtctaagtcctggctcttattggttcatatgaaataatgttaacttcacttctttgtatattatgtataaattagaaaatgaaaaatgtgtgaataacattgtatgaaataaacctggtcttgtgtttttctctagataaaatacccctctgtacctc

SEQ ID NO: 172430 - DNA, 3594 bp, Homo sapiens
  Payload ID: 13895
  Gene Symbol: PUM2
  Gene Name: pumilio RNA-binding family member 2
  Uniprot ID: Q8TB72
  ENST ID: ENST00000403432
  CDS Start-End: 125-3319
attgccgccaccgaaggcggaggagggggaggaccgccaagagcgacgccgccgtgtgcccaacggtcggtgtccccggctgaggcagcgcggccgcagcagccctgtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcagttggcagttctgcaagtagtagtgccacaaggagagagtctctatctactagctctgacttgtacaaaagatctagtagcagcctagcacccatagggcaaccattttacaatagtctgggattttcctcctctccaagtccaataggcatgcctctgccaagccaaactccaggacattcacttacgccaccgccatcactttcatcacatggatcctcatccagtttgcatttaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatc

SEQ ID NO: 172431 - DNA, 955 bp, Homo sapiens
  Payload ID: 13895
  Gene Symbol: PUM2
  Gene Name: pumilio RNA-binding family member 2
  ENST ID: ENST00000442400
  CDS Start-End: 76-955
gaggcagaggaagactgtctccagaattacttgggaagtaaaaatctgcgaggcttggtttgatctgtggatgaaatgaatcatgattttcaagctcttgcattagaatctcggggaatgggagagcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacata

SEQ ID NO: 172432 - DNA, 546 bp, Homo sapiens
  Payload ID: 13895
  Gene Symbol: PUM2
  Gene Name: pumilio RNA-binding family member 2
  ENST ID: ENST00000424110
  CDS Start-End: 443-546
attgccgccaccgaaggcggaggagggggaggaccgccaagagcgacgccgccgtgtgcccaacggtcggtgtccccggctgaggcagcgcggccgcagcagccctgaaacagtcataacctcaaaaatgactttttaattcaaatataagattatactgggtcttggccaaagaaaagtttctgtcgtatatttctgtgttggtgctttcgtgctacagaggcgtagttgagtagctgcagcagagatcatatggcctgcaaagcctaaaatgttgactcctacactaggggtatgatttatcccaacagtaagaatggattcaaagagctaagagacctctcaaaattatccagaggttctttaacttatgtgacctcatctatttggaccactgataaaaacctgaaagtaagcaaaaaaggtttgatctgtggatgaaatgaatcatgattttcaagctcttgcattagaatctcggggaatgggagagcttttgcctaccaaaaagttttgggaacctgatgattcaacaaaagatggaca

SEQ ID NO: 172433 - DNA, 547 bp, Homo sapiens
  Payload ID: 13895
  Gene Symbol: PUM2
  Gene Name: pumilio RNA-binding family member 2
  ENST ID: ENST00000429419
  CDS Start-End: 44-166
gaggcagcgcggccgcagcagccctgtttgatctgtggatgaaatgaatcatgattttcaagctcttgcattagaatctcggggaatgggagagaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttccta

SEQ ID NO: 172434 - DNA, 584 bp, Homo sapiens
  Payload ID: 13895
  Gene Symbol: PUM2
  Gene Name: pumilio RNA-binding family member 2
  ENST ID: ENST00000432105
  CDS Start-End: 88-195
agcattagtgaggaggcagaggaagactgtctccagaattacttgggaagtaaaaatctgcgaggcttggtttgatctgtggatgaaatgaatcatgattttcaagctcttgcattagaatctcggggaatgggagagatgcagaaaagagtccaagtctctcctttgggccacaagagggcaccctgcagctagctaaccctccccttcttcagaacagcgttttccaaagagtatgtcattttcagaggactgatttaaggcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggtagaatatgtattaagttcttctcctgctgataaattggattctcgatttaggaagggaaattttggcactagagatgctgaaacagat

SEQ ID NO: 172435 - DNA, 4352 bp, Homo sapiens
  Payload ID: 13895
  Gene Symbol: PUM2
  Gene Name: pumilio RNA-binding family member 2
  ENST ID: ENST00000440577
  CDS Start-End: 1-2631
cgatttaggaagggaaattttggcactagagatgctgaaacagatggacctgagaaaggagatcaaaaaggcaaggcttctccatttgaggaggaccaaaacagagatcttaaacaaggagatgatgatgattctaaaataaatggcagaggtttgccaaatggaatggatgccgattgcaaagattttaatcgtactcctggaagtcgtcaagcctctccaactgaagtagttgagcgcttgggccccaatactaatccctcagaaggactggggcctcttcctaatcctacagctaataaaccacttgttgaagaattttcaaatcctgaaactcagaatctggatgccatggaacaagttggtctggaatccttacagtttgactatcctggtaatcaggtaccaatggactcttcaggagctactgtaggcctttttgactacaattcccagcagcagctctttcagaggactaatgcactaacagttcaacagttaactgcagctcaacagcagcaatatgcattagcagcagctcagcagccacatatagctggtgtattctcagcaggccttgctccagctgcatttgtgccaaatccatacattattagtgctgctcctccagggaccgatccgtatactgcagcaggattggctgcagcagctacattagcaggtccagcagtggttccacctcagtattacggcgttccatggggggtgtatccagccaacttatttcagcagcaagctgcagctgcggcaaataacacagccagtcagcaagcagcatcacaagctcagcctggacagcaacaggttctccgtgctggagcaggtcagcgtcctcttactcccaatcagggtcagcaagggcagcaagcagaatcacttgcggcagctgcagcagcaaatccaacattggcttttggtcagggtcttgctactggcatgccaggctatcaagtactagctccaactgcctattatgatcagactggtgccttagtggttggccctggagcaaggactggccttggagctccagttcggttaatggctccaacacctgttttaattagttcagcagcagcacaagctgcagcagcagcagcagctggaggaactgcaagtagccttacaggcagcacaaatggtctgtttcggccaattggcactcagccaccacagcagcagcaacagcagccaagcactaatctgcaatctaattcattttatggaagcagttctttgactaatagctcccagagtagttctttattttctcatggacctggtcaacctggaagtacatctcttggctttggaagtggtaactctttgggtgctgctataggctcagccctcagtggatttggttcatcaggaggactgacaaatggtagtggtcgatatatctctgcagcacctggagcagaagcaaaatatcgaagtgcttcaagcacttccagtctatttagctccagcagccagctctttcctccttcccggcttcggtataataggtctgatattatgccttctggccgcagtagattattggaagatttcagaaacaaccgcttcccaaaccttcagcttagagacttgattggacatatagttgagttttctcaagaccagcatggttctagattcatacagcaaaaactagagagagctactccagctgagcgacagatggtatttaatgaaattctgcaagcagcctatcaattaatgactgatgtttttggcaactatgttatacagaagttttttgagtttgggagtctggatcaaaaattagccctggctactcgtattcgtggtcatgttctacccttagccttgcagatgtatggctgccgcgttattcagaaagcattagaatctatttcttctgaccagcagagtgaaatggtaaaggagctggatggtcatgtgctcaaatgtgtgaaagatcagaatggaaaccatgttgtacaaaaatgtatcgaatgtgttcagccacagtcactacagttcatcattgatgctttcaagggacaagtatttgtgctttcaactcatccttatggctgcagagtaattcagcgcatcctagagcattgcactgcagaacagaccttacctatcttagaagaactccaccaacatacagagcagttggtacaggatcagtatggcaattatgttattcagcatgtactggaacacggtcgacctgaagacaagagcaaaattgtttccgaaatcaggggaaaggttttagccctgagtcaacacaaatttgccagcaatgtagtagaaaagtgtgttactcatgcctcccgtgctgagagagctttactgattgacgaggtttgctgccagaatgatggtcctcacagtgccttatacaccatgatgaaggaccagtatgccaattacgtggttcaaaagatgattgatatggctgaacctgctcagagaaagataatcatgcacaagattcgacctcacattactactttgcgcaaatacacatacgggaagcatatactggccaagttggaaaagtattatttgaagaatagcccggacctaggacctattggaggaccaccaaatggaatgctgtaaattacaggagcaagagaaagaagataatttaaccatgtgaaaagaatttttttgtgtgtgaattatcaaaacacaactcaactatgaatcttcaatttttttttaaagcaaaactatttattgactttattcatccatttgtaaattttttaaggttcttgtgtatatttggggggtgggggatgaattataaattatattcagccctgagtggagacctatcagattggattgctggcaaagcacagaatgcctgtatatgatgtaactgtatcaaaaataaaaagctgtcacatattttgtaaatttttaccttgtaaagtcacaaaaatagtttttaaaggaaaaagtacagtattcttttaataaactggctcacagtctggtaggtctacaaccccatagcacaacaggtttatagagatgtatatagaattatagtccttatttttttcctttgcgtgaaaccttttataacagattaacaatcaactgcataaatattattaatattttaaaaagagttaagttgtattttgataattcacaaactatcatgcaaataacgagtaagtagacaagaataaagtggtttgagatgaaaagaacctaacattatttacagtagatgtggttttaatacaattactgccctaaaatgtctctggcaatgtacagaaatattgtatatacttacatatgtaattgttgtaagagttaaatacaaaatcatggtgacacttccaattaagtgcactaaatgaaaagttaagtcacttattaacttttcagtttggtttgcaatgagaaagagtggaaatttgtattttgttttgcttatagaattacagacatgttgaggaagtgttgagctttattttgctttttcatagaggcagaaagtaggaaccagatagagatgaaaaggggccactgaaaagtgaatttgatagctcagcatttaagcatgattacatattcagatagctctttttgctttctataaatatatgcattgtgtgtgtagtaatagatgtaagtttacactttgaaaggaaatcttgtttcaatgtttattataaaagccttgctaatttagtagtgatgctttccttggttgtacaggtgtacatttgtaaaccttcatgctgtaaatggaatttgttttatctctttgggatacatttgcattttagtgtacatttacgtccctgccctctttgacctggcaatatagtgttgtataatgtaaatttatttctccaaatcgagagtgattttttaaaaattttttatctttatatggtttcagaagtatgaaccagctttctttttattattgtgagatcattttgttttataacatagttgttgactgttaatatggacctgctagaatttggatcactttcaattgaagtcagggtattgtgcataatagaaagtattggactgagatatttggttaccatggaggccaatgcttttttcatcttattaaatgtgatgtgacttttttctttgtacagaagagtactgtatttttgaatagcctactcccaagtaagagcaaatctgtatgataacattttttcctctggacataagacataacagtaacacgatgtacatttacaagcggccttatgtacatttcccaacaatctttttaaggcaaaattgtgaccatatgtgtataattaaaatcgtttttaatcctt

SEQ ID NO: 172436 - DNA, 525 bp, Homo sapiens
  Payload ID: 13895
  Gene Symbol: PUM2
  Gene Name: pumilio RNA-binding family member 2
  ENST ID: ENST00000446940
  CDS Start-End: 116-223
gattcggcgcgctggaggttagagaccgagctgtcggccctagggttcggaaagaggggagaggccgggtggccccagagaagcatgcggattgcaagtttgatctgtggatgaaatgaatcatgattttcaagctcttgcattagaatctcggggaatgggagagatgcagaaaagagtccaagtctctcctttgggccacaagagggcaccctgcagctagctaaccctccccttcttcagaacagcgttttccaaagagtatgtcattttcagaggactgatttaaggcttttgcctaccaaaaagttttgggaacctgatgattcaacaaaagatggacaaaaaggcatatttcttggggatgatgaatggagagagactgcatggggagcttctcaccattcaatgtcccagcctattatggtacagagaagatctggacagggttttcatggaaacagtgaagtaaatgcaatactgtctccgcgatcagaaagtggaggccttggtgtgagcatggta

SEQ ID NO: 172437 - DNA, 2321 bp, Homo sapiens
  Payload ID: 13896
  Gene Symbol: PUM3
  Gene Name: pumilio RNA-binding family member 3
  Uniprot ID: Q15397
  ENST ID: ENST00000397885
  CDS Start-End: 208-2154
gcctcaagaggaggcataacagcagcggaccaatagaaattccgaatttttgtattctctgggaagctccacctcttagtccctgatccgccgcggaagatgaaaaaaagcggcccgggggcggagcaaggcaaggaagcggaagcggagaggcggtcgggatccgctgcgcgagctgtctcggtcccacgtgtgcgagttgctacgatggaagttaaagggaaaaagcaattcacaggaaagagtacaaagacagcacaagaaaaaaacagatttcataaaaatagtgattctggttcttcaaagacatttccaacaaggaaagttgctaaagaaggtggacctaaagtcacatctaggaactttgagaaaagtatcacaaaacttgggaaaaagggtgtaaagcagttcaagaataagcagcaaggggacaaatcaccaaagaacaaattccagccggcaaataaattcaacaagaagagaaaattccagccagatggtagaagcgatgaatcagcagccaagaagcccaaatgggatgacttcaaaaagaagaagaaagaactgaagcaaagcagacaactcagtgataaaaccaactatgacattgttgttcgggcaaagcagatgtgggagattttaagaagaaaagactgtgacaaagaaaaaagagtaaagttaatgagtgatttgcagaagttgattcaagggaaaattaaaactattgcatttgcacacgattcaactcgtgtgatccagtgttacattcagtatggtaatgaagaacagagaaaacaggcttttgaagaattgcgagatgatttggttgagttaagtaaagccaaatattcgagaaatattgttaagaaatttctcatgtatggaagtaaaccacagattgcagagataatcagaagttttaaaggccacgtgaggaagatgctgcggcatgcggaagcatcagccatcgtggagtacgcatacaatgacaaagccattttggagcagaggaacatgctgacggaagagctctatgggaacacatttcagctttacaagtcagcagatcaccgaactctggacaaagtgttagaggtacagccagaaaaattagaacttattatggatgaaatgaaacagattctaactccaatggcccaaaaggaagctgtgattaagcactcattggtgcataaagtattcttggacttttttacctatgcaccccccaaactcagatcagaaatgattgaagccatccgcgaagcggtggtctacctggcacacacacacgatggcgccagagtggccatgcactgcctgtggcatggcacgcccaaggacaggaaagtgattgtgaaaacaatgaagacttatgttgaaaaggtggctaatggccaatactcccatttggttttactggcggcatttgattgtattgatgatactaagcttgtgaagcagataatcatatcagaaattatcagttcattgcctagcatagtaaatgacaaatatggaaggaaggtcctattgtacttactaagccccagagatcctgcacatacagtacgagaaatcattgaagttctgcaaaaaggagatggaaatgcacacagtaagaaagatacagaggtccgcagacgggagctcctagaatccatttctccagctttgttaagctacctgcaagaacacgcccaagaagtggtgctagataagtctgcgtgtgtgttggtgtctgacattctgggatctgccactggagacgttcagcctaccatgaatgccatcgccagcttggcagcaacaggactgcatcctggtggcaaggacggagagcttcacattgcagaacatcctgcaggacatctagttctgaagtggttaatagagcaagataaaaagatgaaagaaaatgggagagaaggttgttttgcaaaaacacttgtagagcatgttggtatgaagaacctgaagtcctgggctagtgtaaatcgaggtgccattattctttctagcctcctccagagttgtgacctggaagttgcaaacaaagtcaaagctgcactgaaaagcttgattcctacattggaaaaaaccaaaagcaccagcaaaggaatagaaattctacttgaaaaactgagcacataggtggaaagagttaagagcaagatggaatgattttttctgttctctgttctgtttcccaatgcagaaaagaaggggtagggtccaccatactggtaattggggtactctgtatatgtgtttcttctttgtatacgaatctatttatataaattgtttttttaaatggt

SEQ ID NO: 172438 - DNA, 340 bp, Homo sapiens
  Payload ID: 13896
  Gene Symbol: PUM3
  Gene Name: pumilio RNA-binding family member 3
  ENST ID: ENST00000490444
  CDS Start-End: 1-150
gccattattctttctagcctcctccagagttgtgacctggaagttgcaaacaaagtcaaagctgcactgaaaagcttgattcctacattggaaaaaaccaaaagcaccagcaaaggaatagaaattctacttgaaaaactgagcacataggtggaaagagttaagagcaagatggaatgattttttctgttctctgttctgtttcccaatgcagaaaagaagggaacatccagtcatcaagttccaatgtgttgggcatgaagtcatcattagacaggatgacctttcatcacttggaatatgatcagagaagcagaatttgcctagctcattcagaaga

SEQ ID NO: 172439 - DNA, 1509 bp, Homo sapiens
  Payload ID: 13897
  Gene Symbol: PNP
  Gene Name: purine nucleoside phosphorylase
  Uniprot ID: P00491
  ENST ID: ENST00000361505
  CDS Start-End: 147-1016
ataagccagagcctagaccagtgagccaactgtgcgaaccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttggattttatttaatgtcataatgttgtcagaataaagagaaagatgaaataatttca

SEQ ID NO: 172440 - DNA, 557 bp, Homo sapiens
  Payload ID: 13897
  Gene Symbol: PNP
  Gene Name: purine nucleoside phosphorylase
  ENST ID: ENST00000553418
  CDS Start-End: 277-557
cgacccagcttcccttgtccagggagcaactcagacacagtctcgcttcatttttattctggggttgtacaatctaagggccggcccgcgtgctcgcttgccattggctggggactccagggcaagggatataagccagagcctagaccagtgagccaactgtgcgaaccagacccggcagccttgctcagttcagcatagcggagcggatccgatcggatcggagcggatcggagcacaccggagcaggctcatcgagaaggcgtctgcgagaccatggagaacggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctg

SEQ ID NO: 172441 - DNA, 554 bp, Homo sapiens
  Payload ID: 13897
  Gene Symbol: PNP
  Gene Name: purine nucleoside phosphorylase
  ENST ID: ENST00000554065
  CDS Start-End: 371-554
ttggttagttgtgttcagctctgtcacacctcattgccacctctgaaagcaacgtttggtcttcccagatggatgtgagagaactggacttggaactgggagaaaagtaacacgggttgattcttgctagtgtaggggttctggatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtt

SEQ ID NO: 172442 - DNA, 770 bp, Homo sapiens
  Payload ID: 13897
  Gene Symbol: PNP
  Gene Name: purine nucleoside phosphorylase
  ENST ID: ENST00000553591
  CDS Start-End: 108-770
gagggcaccaggcccgcaggacccttggggaggggcaggtgctgtgacccgggaacctggcacactgggcccagagggagctggcggagggagcgagcgcccaggggatgcagagaggcctggcactgagcctagtgtcgggagcaaggcggcagagtcatgcggcagccagcgcgggcagggacgcacgcgggaatcgagctggggtggcgccaccggagcaggaaggggacagatacacctatgaagattataagaacactgcagaatggcttctgtctcacactaagcaccgacctcaagttgcaataatctgtggttctggattaggaggtctgactgataaattaactcaggcccagatctttgactacggtgaaatccccaactttccccgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggg

SEQ ID NO: 172443 - DNA, 2697 bp, Homo sapiens
  Payload ID: 13898
  Gene Symbol: P2RX1
  Gene Name: purinergic receptor P2X, ligand gated ion channel, 1
  Uniprot ID: P51575
  ENST ID: ENST00000225538
  CDS Start-End: 276-1475
gggaatttatttgtccatgggcgaggctggcctgcagtctgttgccttccaggggccaagagctgctctgatcacccagggattctctctccaacccaagtgcctccagctgacctctggctcctgtcctctggctccacctgcaccgccctgctcttcctaaggggccaggaagcccccagaagctctaccatcgacgtgggtggtggcacccggctcaccctgagagcagaggccgtgcagggggctcagttctgagccccagccggcccaccatggcacggcggttccaggaggagctggccgccttcctcttcgagtatgacaccccccgcatggtgctggtgcgtaataagaaggtgggcgttatcttccgactgatccagctggtggtcctggtctacgtcatcgggtgggtgtttctctatgagaagggctaccagacctcgagcggcctcatcagcagtgtctctgtgaaactcaagggcctggccgtgacccagctccctggcctcggcccccaggtctgggatgtggctgactacgtcttcccagcccagggggacaactccttcgtggtcatgaccaatttcatcgtgaccccgaagcagactcaaggctactgcgcagagcacccagaagggggcatatgcaaggaagacagtggctgtacccctgggaaggccaagaggaaggcccaaggcatccgcacgggcaagtgtgtggccttcaacgacactgtgaagacgtgtgagatctttggctggtgccccgtggaggtggatgacgacatcccgcgccctgcccttctccgagaggccgagaacttcactcttttcatcaagaacagcatcagctttccacgcttcaaggtcaacaggcgcaacctggtggaggaggtgaatgctgcccacatgaagacctgcctctttcacaagaccctgcaccccctgtgcccagtcttccagcttggctacgtggtgcaagagtcaggccagaacttcagcaccctggctgagaagggtggagtggttggcatcaccatcgactggcactgtgacctggactggcacgtacggcactgcagacccatctatgagttccatgggctgtacgaagagaaaaatctctccccaggcttcaacttcaggtttgccaggcactttgtggagaacgggaccaactaccgtcacctcttcaaggtgtttgggattcgctttgacatcctggtggacggcaaggccgggaagtttgacatcatccctacaatgaccaccatcggctctggaattggcatctttggggtggccacagttctctgtgacctgctgctgcttcacatcctgcctaagaggcactactacaagcagaagaagttcaaatacgctgaggacatggggccaggggcggctgagcgtgacctcgcagctaccagctccaccctgggcctgcaggagaacatgaggacatcctgatgctcgggccccaactcctgactgggtgcagcgtgaggcttcagcctggagccctggtgggtcccagccagggcagaggggcctccccaggaagtctcctaccctctcagccaggcagagagcagtttgccagaagctcagggtgcatagtaggagagacctgtgcaaatctgagctccggctccgaccccacacaccctgagggagccctaccctagcctcagccgctcctggtggggaatggctggggctgggcaggaccctcccacacacctgcaccctagcttcgtgcttctctctccggactctcattatccaacccgctgcctccatttctctagatctgtgctctccgatgtggcagtcagtaaccataggtgactaaattaaactaaaataaaatagaatgaaacacaaaattcaattcctcggctgaactagccacatttcaactgctcagtagatacgtgtggttagtggctgccatactggacagctcggggcattttcactgtcaaagaaagttctattagacagccctgcttgagccctgtttcttcctggccttcggtttccctggggaacttatcgacaatgcaagctcctgggcccacccccagacctcctgaaccaaaagctccagggctggccgtatgatctgtgtggatggcaaactccccaggccattctgggacctaagtttaagaagtgccgtcctcgaactttctgactctaagctcctgagcgggagtcagacttagccctgagcctgcacttcctgttcaggtgcagacactgaacagggtctcaaacaccttcagcatgtgtgttgtgtgctcacgtgccacacagtgtctcatgcacacaacccagtgtacacaccacctacgtgcacacagcatccttccacactgtgtatgtgaacagcttgggccctgcaaacacaaccatctacacacatctacacccccaagcacacacacatggtccgtgccatgtcacctccatagggaaaggcttctctccaagtgtgccaggccaggacagccctcccagccatgaatccttactcagctacctcgggttggggtgggagccccagccaaatcctgggctccctgcctgtggctcagccccagctcccaaggcctgcctggctctgtctgaacagaaggtctgggggaagcgacgggtggagtacaataaagggaatgaggacaaa

SEQ ID NO: 172444 - DNA, 1126 bp, Homo sapiens
  Payload ID: 13898
  Gene Symbol: P2RX1
  Gene Name: purinergic receptor P2X, ligand gated ion channel, 1
  ENST ID: ENST00000571637
  CDS Start-End: 252-425
ggctggcctgcagtctgttgccttccaggggccaagagctgctctgatcacccagggattctctctccaacccaagtgcctccagctgacctctggctcctgtcctctggctccacctgcaccgccctgctcttcctaaggggccaggaagcccccagaagctctaccatcgacgtgggtggtggcacccggctcaccctgagagcagaggccgtgcagggggctcagttctgagccccagccggcccaccatggcacggcggttccaggaggagctggccgccttcctcttcgagtatgacaccccccgcatggtgctggtgcgtaataagaaggtgggcgttatcttccgactgatccagctggtggtcctggtctacgtcatcgggggaaggccttcctggcaagccactgtgcgagaatagaaaatcctgccaactcgctgttgagatggggacgaggccggaggggaagccctgcccgggggccttcggtgaacaggaggcagagtctctgggttctgaggagccggctcagtgttatggttcctttgagtggttagtggtgttcagggccagggcaccaccaaccacagccactgagtcctcgacctctgaccgcctgccaaaccaggccgccactgacacacagaggccataccccacacccgtcaccccatatgacaagttagagagagacagactctgctgccagcttccctgcctgagcaagggacatccagggacgtttgaggcccccggagcagagaaactctcacattctgaatacctggtgccttcatgttggcatgtcaggcggaggacagagattggttctggtcccagggatgatagttcctttctgggcatctccggacctgtcccaccgggctgggagtgcagaatcagaggcagcgtgggacgctcctgcagtatggttgtctcgggagccaagacaggcctggcagaggctggcacacttgtgagtgtgcatatggagctctgtgcctatatgtgtctgggtgggtgtttctctatgagaagggctaccagacctcgagcggcctcatcagcagtgtctctgtgaaactcaagggcctggccgtgacccagctccctggcctcgg

SEQ ID NO: 172445 - DNA, 1200 bp, Homo sapiens
  Payload ID: 13899
  Gene Symbol: P2RX2
  Gene Name: purinergic receptor P2X, ligand gated ion channel, 2
  Uniprot ID: Q9UBL9
  ENST ID: ENST00000352418
  CDS Start-End: 1-1200
atggccgccgcccagcccaagtaccccgccggggcgaccgcccggcgcctggcccggggctgctggtccgccctctgggactacgagacgcccaaggtgatcgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgaggcctgaggactgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctga

SEQ ID NO: 172446 - DNA, 1494 bp, Homo sapiens
  Payload ID: 13899
  Gene Symbol: P2RX2
  Gene Name: purinergic receptor P2X, ligand gated ion channel, 2
  Uniprot ID: Q9UBL9
  ENST ID: ENST00000343948
  CDS Start-End: 1-1494
atggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgaggggggcagcgtgttcagcatcatcaccagggtcgaggccacccactcccagacccagggaacctgccccgagagcataagggtccacaacgccacctgcctctccgacgccgactgcgtggctggggagctggacatgctgggaaacggcctgaggactgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtggtaaggaaccctctctggggtcccagcgggtgcggggggtccaccaggcccttacacaccggtctctgctggccccagggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctga

SEQ ID NO: 172447 - DNA, 1344 bp, Homo sapiens
  Payload ID: 13899
  Gene Symbol: P2RX2
  Gene Name: purinergic receptor P2X, ligand gated ion channel, 2
  Uniprot ID: Q9UBL9
  ENST ID: ENST00000350048
  CDS Start-End: 1-1344
atggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgagagcataagggtccacaacgccacctgcctctccgacgccgactgcgtggctggggagctggacatgctgggaaacggcctgaggactgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctga

SEQ ID NO: 172448 - DNA, 1140 bp, Homo sapiens
  Payload ID: 13899
  Gene Symbol: P2RX2
  Gene Name: purinergic receptor P2X, ligand gated ion channel, 2
  Uniprot ID: Q9UBL9
  ENST ID: ENST00000351222
  CDS Start-End: 1-1140
atggccgccgcccagcccaagtaccccgccggggcgaccgcccggcgcctggcccggggctgctggtccgccctctgggactacgagacgcccaaggtgatcgtgagcataagggtccacaacgccacctgcctctccgacgccgactgcgtggctggggagctggacatgctgggaaacggcctgaggactgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctga

SEQ ID NO: 172449 - DNA, 1222 bp, Homo sapiens
  Payload ID: 13899
  Gene Symbol: P2RX2
  Gene Name: purinergic receptor P2X, ligand gated ion channel, 2
  Uniprot ID: Q9UBL9
  ENST ID: ENST00000348800
  CDS Start-End: 1-1215
atggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgaggggggcagcgtgttcagcatcatcaccagggtcgaggccacccactcccagacccagggaacctgccccgagagcataagggtccacaacgccacctgcctctccgacgccgactgcgtggctggggagctggacatgctgggaaacggcctgaggactgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaagatggtggacactcctgcctccgagcctgcccaagcctccacacccacagaccccaaaggtttggctcaactctgagctcctt

SEQ ID NO: 172450 - DNA, 1867 bp, Homo sapiens
  Payload ID: 13899
  Gene Symbol: P2RX2
  Gene Name: purinergic receptor P2X, ligand gated ion channel, 2
  Uniprot ID: Q9UBL9
  ENST ID: ENST00000389110
  CDS Start-End: 38-1453
ctgcagcgccttcctggaggtgggggccgcccgcgccatggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgaggggggcagcgtgttcagcatcatcaccagggtcgaggccacccactcccagacccagggaacctgccccgagagcataagggtccacaacgccacctgcctctccgacgccgactgcgtggctggggagctggacatgctgggaaacggcctgaggactgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctgagctcctttccatctcactggactgcagacccggcctggtggggccagagagtccccagctagggacctgcacgtggacgtgggcacctcagtagcggagcatctccacgaaacggggcaccacaggatccctgtgcaagggctgggggcacgctctggccccaggcttgtgccccaccctggcatacagcccctgacacctcctccccagctggtccctacagggctgctcacttcccatcacctctcacagccacctggaacccaagccagctgagctctgaggggctctgctcccggtcttgggccctgggaaccccaccccaccccaccccacaggcgttgtaaccttgaatctgcccagactcttcccttagaagtcacaacatactcagtccaataaacctgtgagcag

SEQ ID NO: 172451 - DNA, 1113 bp, Homo sapiens
  Payload ID: 13899
  Gene Symbol: P2RX2
  Gene Name: purinergic receptor P2X, ligand gated ion channel, 2
  Uniprot ID: Q9UBL9
  ENST ID: ENST00000449132
  CDS Start-End: 1-1113
atggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgagagcataagggtccacaacgccacctgcctctccgacgccgactgcgtggctggggagctggacatgctgggaaacggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaaggcaggggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggccgggaagttcagcctgattcccaccattattaatctggccacagctctgacttccgtcggggtgggctccttcctgtgcgactggatcttgctaacattcatgaacaaaaacaaggtctacagccataagaaatttgacaagatggtggacactcctgcctccgagcctgcccaagcctccacacccacagaccccaaaggtttggctcaactctga

SEQ ID NO: 172452 - DNA, 1881 bp, Homo sapiens
  Payload ID: 13899
  Gene Symbol: P2RX2
  Gene Name: purinergic receptor P2X, ligand gated ion channel, 2
  ENST ID: ENST00000542301
  CDS Start-End: 1-1050
atggccgccgcccagcccaagtaccccgccggggcgaccgcccggcgcctggcccggggctgctggtccgccctctgggactacgagacgcccaaggtgatcgtggtgaggaaccggcgcctgggggtcctgtaccgcgccgtgcagctgctcatcctgctctacttcgtgtggtacgtattcatcgtgcagaaaagctaccaggagagcgagacgggccccgagagctccatcatcaccaaggtcaaggggatcaccacgtccgagcacaaagtgtgggacgtggaggagtacgtgaagccccccgaggggggcagcgtgttcagcatcatcaccagggtcgaggccacccactcccagacccagggaacctgccccgagagcataagggtccacaacgccacctgcctctccgacgccgactgcgtggctggggagctggacatgctgggaaacggcctgaggactgggcgctgtgtgccctattaccaggggccctccaagacctgcgaggtgttcggctggtgcccggtggaagatggggcctctgtcagccaatttctgggtacgatggccccaaatttcaccatcctcatcaagaacagcatccactaccccaaattccacttctccaagggcaacatcgccgaccgcacagacgggtacctgaagcgctgcacgttccacgaggcctccgacctctactgccccatcttcaagctgggctttatcgtggagaaggctggggagagcttcacagagctcgcacacaagggtggtgtcatcggggtcattatcaactgggactgtgacctggacctgcctgcatcggagtgcaaccccaagtactccttccggaggcttgaccccaagcacgtgcctgcctcgtcaggctacaacttcaggtttgccaaatactacaagatcaatggcaccaccacccgcacgctcatcaaggcctacgggatccgcattgacgtcattgtgcatggacaggtgcctgcacctgctgggggccgggaagttcagcctgattcccaccattattaatctggccacagctctgacttccgtcggggtggtaaggaaccctctctggggtcccagcgggtgcggggggtccaccaggcccttacacaccggtctctgctggccccagggctccttcctgtgcgactggatcttgctaacattcatgaacaaaaacaaggtctacagccataagaaatttgacaaggtgtgtacgccgagccacccctcaggtagctggcctgtgacccttgcccgtgtattgggccaggcccctcccgaacccggccaccgctccgaggaccagcaccccagccctccatcaggccaggagggccaacaaggggcagagtgtggcccagccttcccgcccctgcggccttgccccatctctgccccttctgagcagatggtggacactcctgcctccgagcctgcccaagcctccacacccacagaccccaaaggtttggctcaactctgagctcctttccatctcactggactgcagacccggcctggtggggccagagagtccccagctagggacctgcacgtggacgtgggcacctcagtagcggagcatctccacgaaacggggcaccacaggatccctgtgcaagggctgggggcacgctctggccccaggcttgtgccccaccctggcatacagcccctgacacctcctccccagctggtccctacagggctgctcacttcccatcacctctcacagccacctggaacccaagccagctgagctctgaggggctctgctcccggtcttgggccctgggaaccccaccccaccccaccccacaggcgttgtaaccttgaatctgcccagactct

SEQ ID NO: 172453 - DNA, 1831 bp, Homo sapiens
  Payload ID: 13900
  Gene Symbol: P2RX3
  Gene Name: purinergic receptor P2X, ligand gated ion channel, 3
  Uniprot ID: P56373
  ENST ID: ENST00000263314
  CDS Start-End: 35-1228
ccccttctgagtgtcccctgagcactctctcagcatgaactgcatatccgacttcttcacctatgagaccaccaagtcggtggttgtgaagagctggaccatcgggatcatcaaccgagtagttcagcttctgatcatctcctactttgtagggtgggttttcttgcacgagaaggcttaccaggtacgggacacagccattgagtcctcggtggtaaccaaggtgaagggctccggactctacgccaacagagtcatggatgtgtctgattacgtgacgccacctcagggcacctcggtctttgtcatcatcaccaagatgattgttactgaaaatcagatgcaaggattctgcccagagagtgaggagaaataccgctgtgtatcagacagccagtgcgggcctgagcgcttgccaggtggggggatcctcactggccgctgcgtgaactacagctctgtgctccggacctgtgagatccagggctggtgccccacggaggtggacacagtggaaacgcccatcatgatggaagctgagaacttcactattttcatcaagaacagcatccgtttccccctcttcaactttgagaagggaaacctccttcccaacctgacagccagggacatgaagacctgccgcttccacccggacaaggaccctttctgccccatcttgcgggtaggggacgtggtcaagtttgcggggcaggattttgccaaactggcgcgcacggggggagttctgggcattaagatcggctgggtgtgcgacttggacaaggcctgggaccagtgcatccccaaatactccttcacccggctcgacagcgtttctgagaaaagcagcgtgtccccaggctacaacttcaggtttgccaagtactacaaaatggaaaatggcagtgagtaccgcaccctcctgaaggcttttggcatccgcttcgacgtgctggtatacgggaatgctggcaagttcaacatcatccccaccatcatcagctctgtggcggcctttacttctgtgggagtgggaactgttctctgtgacatcatcctgctcaacttcctcaagggggccgaccagtacaaagccaagaagtttgaggaggtgaatgagactacgctgaaaatcgcggctttgaccaacccagtgtaccccagcgaccagaccacagcggagaagcagtccaccgattcgggggccttctccataggccactagggcctctttccagggccccacactcacaaaggctccaggcctccccacagaggaccctgcctgagcaaggggcatgggagggaagaggggctctcatttctgctgctcattccatgagcatagctgggacccaagtgtctgggcctccgactgctccagcagacaggcagtgctccctgctgagaccccaatctcaccttcactccttgcctggccccatctgcttcctaggacccctggggcaggagcacctgagccatccccttcccaaagagtagagattataatgtaggacagatggccacaagggcctaccaagtgccaggcactttcacacacgttatctcatttaatccttagaataatcctatgaggtagatattagtttcccttgttttgaagataaaccaaggctcagagagactgagtcatttgccccaggccagatagccaggatgtgagagagctgggatttgaacgtccgtctgactaactccatcgcccacaccccatgagagaagaatgaactcccagggtccatcagccctgctgcttcagccgcctccaccctgacggtgattcggttaataaagagtaagcccc

SEQ ID NO: 172454 - DNA, 837 bp, Homo sapiens
  Payload ID: 13900
  Gene Symbol: P2RX3
  Gene Name: purinergic receptor P2X, ligand gated ion channel, 3
  ENST ID: ENST00000534820
  CDS Start-End: 1-153
aaataccgctgtgtatcagacagccagtgcgggcctgagcgcttgccaggtggggggatcctcactggccgctgcgtgaactacagctctgtgctccggacctgtgagatccagggctggtgccccacggaggtggacacagtggaaacgtaaggctccaagccagacaggaggagacaggcccccacctcagctcccctttgcccatgtgggagccgtgcgtctctgagcttgaggagggcccatcatgatggaagctgagaacttcactattttcatcaagaacagcatccgtttccccctcttcaactttgagaagggaaacctccttcccaacctgacagccagggacatgaagacctgccgcttccacccggacaaggaccctttctgccccatcttgcgggtaggggacgtggtcaagtttgcggggcaggattttgccaaactggcgcgcacgagtctcgatctgtctcccaggctagagtgcatggcgcgatttcggctcactgcaacctccgcctcccaggttcacgccattctcctgcctcagcttccggagtagctgggaccaagcccggctaatttttggtatttttagtagagtcaggggttcgccgtgttagccaggatggtctcgatctcctgacctcgtgatccgcccgcctcggcctcccaaagtgctgggattacaggcgtgaatcaccgcacccggccaccacagcacttctttactgagcagtatatgacatgtcactttccgttctccctgcctccgtctcccacctggaggatgggaggaaatcatttgtcaccacctccaccccacccccaccc

SEQ ID NO: 172455 - DNA, 1346 bp, Homo sapiens
  Payload ID: 13900
  Gene Symbol: P2RX3
  Gene Name: purinergic receptor P2X, ligand gated ion channel, 3
  ENST ID: ENST00000616487
  CDS Start-End: 77-1267
cctgtcctgtaggacctccctctcctgaggccaccactgggcccccttctgagtgtcccctgagcactctctcagcatgaactgcatatccgacttcttcacctatgagaccaccaagtcggtggttgtgaagagctggaccatcgggatcatcaaccgagtagttcagcttctgatcatctcctactttgtagggtgggttttcttgcacgagaaggcttaccaggtacgggacacagccattgagtcctcggtggtaaccaaggtgaagggctccggactctacgccaacagagtcatggatgtgtctgattacgtgacgccacctcagggcacctcggtctttgtcatcatcaccaagatgattgttactgaaaatcagatgcaaggattctgcccagagagtgaggagaaataccgctgtgtatcagacagccagtgcgggcctgagcgcttgccaggtggggggatcctcactggccgctgcgtgaactacagctctgtgctccggacctgtgagatccagggctggtgccccacggaggtggacacagtggaaacgcccatcatgatggaagctgagaacttcactattttcatcaagaacagcatccgtttccccctcttcaactttgagaagggaaacctccttcccaacctgacagccagggacatgaagacctgccgcttccacccggacaaggaccctttctgccccatcttgcgggtaggggacgtggtcaagtttgcggggcaggattttgccaaactggcgcgcacggggggagttctgggcattaagatcggctgggtgtgcgacttggacaaggcctgggaccagtgcatccccaaatactccttcacccggctcgacagcgtttctgagaaaagcagcgtgtccccaggctacaacttcaggtttgccaagtactacaaaatggaaaatggcagtgagtaccgcaccctcctgaaggcttttggcatccgcttcgacgtgctgtatacgggagctggcaagttcaacatcatccccaccatcatcagctctgtggcggcctttacttctgtgggagtgggaactgttctctgtgacatcatcctgctcaacttcctcaagggggccgaccagtacaaagccaagaagtttgaggaggtgaatgagactacgctgaaaatcgcggctttgaccaacccagtgtaccccagcgaccagaccacagcggagaagcagtccaccgattcgggggccttctccataggccactagggcctctttccagggccccacactcacaaaggctccaggcctccccacagaggaccctgcctgagcaaggggcatggga

SEQ ID NO: 172456 - DNA, 2032 bp, Homo sapiens
  Payload ID: 13901
  Gene Symbol: P2RX4
  Gene Name: purinergic receptor P2X, ligand gated ion channel, 4
  Uniprot ID: Q99571
  ENST ID: ENST00000337233
  CDS Start-End: 309-1475
ccgcaagtgctgggatgacaggtgtgagccaccgcccccggcccctcgcccgccttttgaaggagcctttcgtcctcaagggcgaggccactccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaa

SEQ ID NO: 172457 - DNA, 1836 bp, Homo sapiens
  Payload ID: 13901
  Gene Symbol: P2RX4
  Gene Name: purinergic receptor P2X, ligand gated ion channel, 4
  Uniprot ID: Q99571
  ENST ID: ENST00000359949
  CDS Start-End: 101-1315
gcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgctaccatccccatttggcagaagtggaaatggagtcccctagaaggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggt

SEQ ID NO: 172458 - DNA, 866 bp, Homo sapiens
  Payload ID: 13901
  Gene Symbol: P2RX4
  Gene Name: purinergic receptor P2X, ligand gated ion channel, 4
  ENST ID: ENST00000538417
  CDS Start-End: 1-371
gcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacgacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcagggcccaaggtcctgccccagccatctccccctgatccatcctccttcccctcaggtttgccaagtactacagagacctggctggcaacgagcagcgcacgctcatcaaggcctatggcatccgcttcgacatcattgtgtttgggaagg

SEQ ID NO: 172459 - DNA, 1777 bp, Homo sapiens
  Payload ID: 13901
  Gene Symbol: P2RX4
  Gene Name: purinergic receptor P2X, ligand gated ion channel, 4
  ENST ID: ENST00000543171
  CDS Start-End: 305-1330
aagtgctgggatgacaggtgtgagccaccgcccccggcccctcgcccgccttttgaaggagcctttcgtcctcaagggcgaggccactccccccccgcgagttccatgccccctagagggtcatcgttcccgacggggaggtggcgccctcccccgggccccgggccccgaccgcccgtgctgcctccttccgggccctcctccgcgatgacggcgccgccagcaggccaggcggactgggcggggctccgagcggggactgggacccagaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccaagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttctt

SEQ ID NO: 172460 - DNA, 1084 bp, Homo sapiens
  Payload ID: 13901
  Gene Symbol: P2RX4
  Gene Name: purinergic receptor P2X, ligand gated ion channel, 4
  Uniprot ID: Q99571
  ENST ID: ENST00000542067
  CDS Start-End: 1-1084
atggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcagacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagt

SEQ ID NO: 172461 - DNA, 1612 bp, Homo sapiens
  Payload ID: 13901
  Gene Symbol: P2RX4
  Gene Name: purinergic receptor P2X, ligand gated ion channel, 4
  ENST ID: ENST00000543984
  CDS Start-End: 37-195
agaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacggagtctcaacaggcaggtgcgtagctttcaacgggtctgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccaggaggtcagcagtctgttcttggctgggtcaactctgcttttcccgcaacctggggttgtcgggggagcgctggcccgacgcagtggcactgctgtggctttcagggctggagctggctttgctcagaagcctcctgtctccagctctctccaggacaggcccagtcctctgaggcacggcggctctgttcaagcactttatgcggcaggggaggccgcctggctgcagtcactagacttgtagcaggcctgggctgcaggcttccccccgaccattccctgcagccatgcggcagagctggcatttctcctcagagaagcgctgtgctaaggtgatcgaggaccagacattaaagcgtgattttcttaa

SEQ ID NO: 172462 - DNA, 451 bp, Homo sapiens
  Payload ID: 13901
  Gene Symbol: P2RX4
  Gene Name: purinergic receptor P2X, ligand gated ion channel, 4
  ENST ID: ENST00000538701
  CDS Start-End: 15-451
cgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcggacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactcctt

SEQ ID NO: 172463 - DNA, 1429 bp, Homo sapiens
  Payload ID: 13901
  Gene Symbol: P2RX4
  Gene Name: purinergic receptor P2X, ligand gated ion channel, 4
  ENST ID: ENST00000543318
  CDS Start-End: 37-483
agaccgactaggggactgggagcgggcggcgcggccatggcgggctgctgcgccgcgctggcggccttcctgttcgagtacgacacgccgcgcatcgtgctcatccgcagccgcaaagtggggctcatgaaccgcgccgtgcaactgctcatcctggcctacgtcatcgggtgggtgtttgtgtgggaaaagggctaccaggaaactgactccgtggtcagctccgttacgaccaaggtcaagggcgtggctgtgaccaacacttctaaacttggattccggatctgggatgtggcggattatgtgataccagctcaggaggaaaactccctcttcgtcatgaccaacgtgatcctcaccatgaaccagacacagggcctgtgccccgagattccagatgcgaccactgtgtgtaaatcagatgccagctgtactgccggctctgccggcacccacagcaacgcttggcatcaccctggctgagatgtggctggcacacaggagtctcaacaggcaggtgcgtagctttcaacgggtctgtcaagacgtgtgaggtggcggcctggtgcccggtggaggatgacacacacgtgccacaacctgcttttttaaaggctgcagaaaacttcactcttttggttaagaacaacatctggtatcccaaatttaatttcagcaagaggaatatccttcccaacatcaccactacttacctcaagtcgtgcatttatgatgctaaaacagatcccttctgccccatattccgtcttggcaaaatagtggagaacgcaggacacagtttccaggacatggccgtggagggaggcatcatgggcatccaggtcaactgggactgcaacctggacagagccgcctccctctgcttgcccaggtactccttccgccgcctcgatacacgggacgttgagcacaacgtatctcctggctacaatttcaggtttgccaagtactacagagacctggctggcaacgagcagcgcacgctcatcaaggcctatggcatccgcttcgacatcattgtgtttgggaaggcagggaaatttgacatcatccccactatgatcaacatcggctctggcctggcactgctaggcatggcgaccgtgctgtgtgacatcatagtcctctactgcatgaagaaaagactctactatcgggagaagaaatataaatatgtggaagattacgagcagggtcttgctagtgagctggaccagtgaggcctaccccacacctgggctctccacagccccatcaaagaacagagaggaggaggagggagaaatggccaccacatcaccccagagaaatttctggaatctgattgagtctccactccacaagcactcagggttccccagcagctcctgtgtgttgtgtgcaggatctgtttgcccactcggcccag

SEQ ID NO: 172464 - DNA, 2309 bp, Homo sapiens
  Payload ID: 13902
  Gene Symbol: P2RX5
  Gene Name: purinergic receptor P2X, ligand gated ion channel, 5
  Uniprot ID: Q93086
  ENST ID: ENST00000225328
  CDS Start-End: 400-1668
tccgcgatcgctgctttcagctgggcaacagcacagggcggtcctgcgcatccggggggctgcgctcccagaccggtggctggggagtaggttgcaggggtgtcactgtgtcaggggaggaggaggaggaggaggaagaagaggtagcggcaaggtcgcggtctgaggttccggtgctcgccgccgcccagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaa

SEQ ID NO: 172465 - DNA, 2031 bp, Homo sapiens
  Payload ID: 13902
  Gene Symbol: P2RX5
  Gene Name: purinergic receptor P2X, ligand gated ion channel, 5
  Uniprot ID: Q93086
  ENST ID: ENST00000345901
  CDS Start-End: 212-1408
cagctcccagccgaggctttctcaaccgcgtcaataaaaggccgccccgacccgcccccgcgccccgcagccctgccggacaccccgggctgcagctgagcgggcgcagacgggccgaggcgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaata

SEQ ID NO: 172466 - DNA, 1863 bp, Homo sapiens
  Payload ID: 13902
  Gene Symbol: P2RX5
  Gene Name: purinergic receptor P2X, ligand gated ion channel, 5
  Uniprot ID: Q93086
  ENST ID: ENST00000551178
  CDS Start-End: 29-1222
ggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaacaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaa

SEQ ID NO: 172467 - DNA, 851 bp, Homo sapiens
  Payload ID: 13902
  Gene Symbol: P2RX5
  Gene Name: purinergic receptor P2X, ligand gated ion channel, 5
  ENST ID: ENST00000552456
  CDS Start-End: 1-89
tccgctttgacgtgatggtgaacggcaaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaa

SEQ ID NO: 172468 - DNA, 1998 bp, Homo sapiens
  Payload ID: 13902
  Gene Symbol: P2RX5
  Gene Name: purinergic receptor P2X, ligand gated ion channel, 5
  Uniprot ID: Q93086
  ENST ID: ENST00000547178
  CDS Start-End: 92-1357
cgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaacaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaa

SEQ ID NO: 172469 - DNA, 858 bp, Homo sapiens
  Payload ID: 13902
  Gene Symbol: P2RX5
  Gene Name: purinergic receptor P2X, ligand gated ion channel, 5
  ENST ID: ENST00000552723
  CDS Start-End: 1-858
gggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgccc

SEQ ID NO: 172470 - DNA, 1536 bp, Homo sapiens
  Payload ID: 13902
  Gene Symbol: P2RX5
  Gene Name: purinergic receptor P2X, ligand gated ion channel, 5
  ENST ID: ENST00000552050
  CDS Start-End: 180-1268
cttgtcgcctctgctgcttgcaggactgggtttcagtcagcagtgggagctgtggcccctgcccaggagctggtgggacaggtggagccctgagcctgctccacctcaactaggagttgctgtgactgctaccccaccccaaggcctggggaagctccccgaagccagcagagtggctgatgcccacgtaccggcccccttcccacagatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaagcaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcacta

SEQ ID NO: 172471 - DNA, 1642 bp, Homo sapiens
  Payload ID: 13902
  Gene Symbol: P2RX5
  Gene Name: purinergic receptor P2X, ligand gated ion channel, 5
  ENST ID: ENST00000552276
  CDS Start-End: 92-1387
cgggcgccgggcgcgcagggaccgagggaccgagtgctccccatgagcgcacgtgggccgggcggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagagaacttggccaggggcacctgtgagatctttgcctggtgcccgttggagacaagctccaggccggaggagccattcctgaaggaggccgaagacttcaccattttcataaagaaccacatccgtttccccaaattcaacttctccaacaatgtgatggacgtcaaggacagatctttcctgaaatcatgccactttggccccaagaaccactactgccccatcttccgactgggctccgtgatccgctgggccgggagcgacttccaggatatagccctggagggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggctgaggactccctctgcttctcccttacaccaggaatgaacctttccttcccactcagaggaggttctgagaggactgaggtgggcaaaccactgaggatcttcagtgggggcagagaaagggctcactgagatggggggcaacgctatggcctcagcttctccttggcgtcgtgtgcatgtgttcctgaagccgaaacggaatttaacaggtctgggtcccagatccatttccatgactggccatgggctatctatgatctgtcaaaaggggacttggattcaagctctcaga

SEQ ID NO: 172472 - DNA, 1834 bp, Homo sapiens
  Payload ID: 13903
  Gene Symbol: P2RX6
  Gene Name: purinergic receptor P2X, ligand gated ion channel, 6
  Uniprot ID: O15547
  ENST ID: ENST00000401443
  CDS Start-End: 6-1253
gactcatgtgcccgcagctagcaggagctggcagcatgggctccccaggggctacgacaggctgggggcttctggattataagacggagaagtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcagggagagaacgtgttcttcttggtgaccaacttccttgtgacgccagcccaagttcagggcagatgcccagagcacccgtccgtcccactggctaactgctgggtcgacgaggactgccccgaaggggagggaggcacacacagccacggtgtaaaaacaggccagtgtgtggtgttcaatgggacccacaggacctgtgagatctggagttggtgccccgtggagagtggcgttgtgccctcgaggcccctgctggcccaggcccagaacttcacactgttcatcaaaaacacagtcaccttcagcaagttcaacttctctaagtccaatgccttggagacctgggaccccacctattttaagcactgccgctatgaaccacaattcagcccctactgtcccgtgttccgcattggggacctcgtggccaaggctggagggaccttcgaggacctggcgttgctgggtggctctgtaggcatcagagttcactgggattgtgacctggacaccggggactctggctgctggcctcactactccttccagctgcaggagaagagctacaacttcaggacagccactcactggtgggagcaaccgggtgtggaggcccgcaccctgctcaagctctatggaatccgcttcgacatcctcgtcaccgggcaggcagggaagttcgggctcatccccacggccgtcacactgggcaccggggcagcttggctgggcgtggtcacctttttctgtgacctgctactgctgtatgtggatagagaagcccatttctactggaggacaaagtatgaggaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggtatgcttaccagctgtcagcacagaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggc

SEQ ID NO: 172473 - DNA, 576 bp, Homo sapiens
  Payload ID: 13903
  Gene Symbol: P2RX6
  Gene Name: purinergic receptor P2X, ligand gated ion channel, 6
  ENST ID: ENST00000452228
  CDS Start-End: 1-361
gcagctagcaggagctggcagcatgggctccccaggggctacgacaggctgggggcttctggattataagacggagaagtatgtgatgaccaggaactggcgggtgggcgccctgcagaggctgctgcagtttgggatcgtggtctatgtggtagggtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcaggctgccggcttccggcctttccagtcaacacgagcccagccaggccaaccttgagacttgcctcctagggagagaacgtgttcttcttggtgaccaacttccttgtgacgccagcccaagttcagggcagatgcccagaggtgtaaaaacaggccagtgtgtggtgttcaatgggacccacaggacctgtgagatctggagttggtgccccgtggagagtggcgttgtgccctcgaggcccctgctggcccaggcccagaacttcacac

SEQ ID NO: 172474 - DNA, 2513 bp, Homo sapiens
  Payload ID: 13903
  Gene Symbol: P2RX6
  Gene Name: purinergic receptor P2X, ligand gated ion channel, 6
  ENST ID: ENST00000442475
  CDS Start-End: 23-265
gctgcagctgccatgctgactcatgtgcccgcagctagcaggagctggcagcatgggctccccaggggctacgacaggctgggggcttctggattataagacggagaagtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcaggtgtaaaaacaggccagtgtgtggtgttcaatgggacccacaggacctgtgagatctggagttggtgccccgtggagagtggcgttgtgccctcgaggcccctgctggcccaggcccagaacttcacactgttcatcaaaaacacagtcaccttcagcaagttcaacttctctaagtccaatgccttggagacctgggaccccacctattttaagcactgccgctatgaaccacaattcagcccctactgtcccgtgttccgcattggggacctcgtggccaaggctggagggaccttcgaggacctggcgttgctgggtggctctgtaggcatcagagttcactgggattgtgacctggacaccggggactctggctgctggcctcactactccttccagctgcaggagaagagctacaacttcaggacagccactcactggtgggagcaaccgggtgtggaggcccgcaccctgctcaagctctatggaatccgcttcgacatcctcgtcaccgggcaggcagggaagttcgggctcatccccacggccgtcacactgggcaccggggcagcttggctgggcgtggtcacctttttctgtgacctgctactgctgtatgtggatagagaagcccatttctactggaggacaaagtatgaggaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggtatgcttaccagctgtcagcacagaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcattgggttcttcaggaccttctatatccctcctcggtaaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagcca

SEQ ID NO: 172475 - DNA, 2150 bp, Homo sapiens
  Payload ID: 13903
  Gene Symbol: P2RX6
  Gene Name: purinergic receptor P2X, ligand gated ion channel, 6
  ENST ID: ENST00000432930
  CDS Start-End: 1-393
ctagcaggagctggcagcatgggctccccaggggctacgacaggctgggggcttctggattataagacggagaagtatgtgatgaccaggaactggcgggtgggcgccctgcagaggctgctgcagtttgggatcgtggtctatgtggtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcagggagagaacgtgttcttcttggtgaccaacttccttgtgacgccagcccaagttcagggcagatgcccagagcacccgtccgtcccactggctaactgctgggtcgacgaggactgccccgaaggggagggaggcacacacagccacggtgtaaaaacaggccagtgtgtggtgttcaatgggacccacaggacctgtgagatctggagttggtgccccgtggagagtggcgttgtgccctcgaggcccctgctggcccaggcccagaacttcacactgttcatcaaaaacacagtcaccttcagcaagttcaacttctctaagtccaatgccttggagacctgggaccccacctattttaagcactgccgctatgaaccacaattcagcccctactgtcccgtgttccgcattggggacctcgtggccaaggctggagggaccttcgaggacctggcgttgctgggtggctctgtaggcatcagagttcactgggattgtgacctggacaccggggactctggctgctggcctcactactccttccagctgcaggagaagagctacaacttcaggacagccactcactggtgggagcaaccgggtgtggaggcccgcaccctgctcaagctctatggaatccgcttcgacatcctcgtcaccgggcaggcagggaagttcgggctcatccccacggccgtcacactgggcaccggggcagcttggctgggcgtggtcacctttttctgtgacctgctactgctgtatgtggatagagaagcccatttctactggaggacaaagtatgaggaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagcca

SEQ ID NO: 172476 - DNA, 2009 bp, Homo sapiens
  Payload ID: 13903
  Gene Symbol: P2RX6
  Gene Name: purinergic receptor P2X, ligand gated ion channel, 6
  ENST ID: ENST00000422210
  CDS Start-End: 1-306
gcaggagctggcagcatgggctccccaggggctacgacaggctgggggcttctggattataagacggagaagtatgtgatgaccaggaactggcgggtgggcgccctgcagaggctgctgcagtttgggatcgtggtctatgtggtagggtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcaggtgtaaaaacaggccagtgtgtggtgttcaatgggacccacaggacctgtgagatctggagttggtgccccgtggagagtggcgttgtgccctcgaggcccctgctggcccaggcccagaacttcacactgttcatcaaaaacacagtcaccttcagcaagttcaacttctctaagtccaatgccttggagacctgggaccccacctattttaagcactgccgctatgaaccacaattcagcccctactgtcccgtgttccgcattggggacctcgtggccaaggctggagggaccttcgaggacctggcgttgctgggtggctctgtaggcatcagagttcactgggattgtgacctggacaccggggactctggctgctggcctcactactccttccagctgcaggagaagagctacaacttcaggacagccactcactggtgggagcaaccgggtgtggaggcccgcaccctgctcaagctctatggaatccgcttcgacatcctcgtcaccgggcaggcagggaagttcgggctcatccccacggccgtcacactgggcaccggggcagcttggctgggcgtggtcacctttttctgtgacctgctactgctgtatgtggatagagaagcccatttctactggaggacaaagtatgaggaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagccaccctc

SEQ ID NO: 172477 - DNA, 3687 bp, Homo sapiens
  Payload ID: 13903
  Gene Symbol: P2RX6
  Gene Name: purinergic receptor P2X, ligand gated ion channel, 6
  Uniprot ID: O15547
  ENST ID: ENST00000413302
  CDS Start-End: 149-1474
ctgggattaggggttgagggctgggtgttggaggctggatctggatcctgctttagtggaagtgtccctttaacagcaactggcctggcctggctcgggccctgctttgcctcctgttcagctgcggctgcagctgccatgctgactcatgtgcccgcagctagcaggagctggcagcatgggctccccaggggctacgacaggctgggggcttctggattataagacggagaagtatgtgatgaccaggaactggcgggtgggcgccctgcagaggctgctgcagtttgggatcgtggtctatgtggtagggtgggctctcctcgccaaaaaaggctaccaggagcgggacctggaaccccagttttccatcatcaccaaactcaaaggggtttccgtcactcagatcaaggagcttggaaaccggctgtgggatgtggccgacttcgtgaagccacctcagggagagaacgtgttcttcttggtgaccaacttccttgtgacgccagcccaagttcagggcagatgcccagagcacccgtccgtcccactggctaactgctgggtcgacgaggactgccccgaaggggagggaggcacacacagccacggtgtaaaaacaggccagtgtgtggtgttcaatgggacccacaggacctgtgagatctggagttggtgccccgtggagagtggcgttgtgccctcgaggcccctgctggcccaggcccagaacttcacactgttcatcaaaaacacagtcaccttcagcaagttcaacttctctaagtccaatgccttggagacctgggaccccacctattttaagcactgccgctatgaaccacaattcagcccctactgtcccgtgttccgcattggggacctcgtggccaaggctggagggaccttcgaggacctggcgttgctgggtggctctgtaggcatcagagttcactgggattgtgacctggacaccggggactctggctgctggcctcactactccttccagctgcaggagaagagctacaacttcaggacagccactcactggtgggagcaaccgggtgtggaggcccgcaccctgctcaagctctatggaatccgcttcgacatcctcgtcaccgggcaggcagggaagttcgggctcatccccacggccgtcacactgggcaccggggcagcttggctgggcgtggtcacctttttctgtgacctgctactgctgtatgtggatagagaagcccatttctactggaggacaaagtatgaggaggccaaggccccgaaagcaaccgccaactctgtgtggagggagctggcccttgcatcccaagcccgactggccgagtgcctcagacggagctcagcacctgcacccacggccactgctgctgggagtcagacacagacaccaggatggccctgtccaagttctgacacccacttgccaacccattccgggagcctgtagccgttccctgctggttgagagttgggggctgggaagggcggggccctgcctggggatctcaaggatgaggccccagcatggaggattgggggtagaattccacccttgaaccccagcagacagtccctcccctgactcccaccttggtagggtgctgcctcagggagccatagaagtcggctgtgttttgagacggcgacagaacctgacccgtggagactgggagagcccagcaggcacctgtattgcagggctccgactgcatgtggcaggggctcctgctgcgtctgggcctggaggtctctctcccagtgctctgtccccagtgttcctagcagaggtatgcttaccagctgtcagcacagaccctcctgctgcctgggtcctggccctcctcccccatctgcacccccatcataggtagagaccccaccctcccatcggtcctacatggggctgtgcagctggagccaaaaaggcaaggtagaaagaggagtgatgggggagggggattgtttcagcttctctggtgctgtgatgccccaggagagtcctaatctagggaatggggtggagtaggcagataatccacctccctatcccccaggcaagggcggagcatgtgtcttgggcccacacctgcttagtttatgaggaccggctgctttccagtggtagcccttttgccatggaggtctgggagagagagcagagggcggcagggctaagttggtgatcattgggttcttcaggaccttctatatccctcctcggtaaccccccagcccaaccccttggaatctttcctccaggcttcctgagagccctgggggtgggaggctgtgggaggctgtacatctgaaattcacttcagtccaagtcatacctaggaagctgtctgggcagctgctcgagggaggccctggctctgatcccaggctggatggagtggctggaaggaatggttccaaacaacaccaccgagatctccctcaggctggccaggttttgcagctggaattctcctcttggtcccagggcggggcagggaattctaagtgtccaccccagggaggcaaggggctgctttccactgtgggtacctggtgatcagggcaagctgtggagggccaggggtggggctgagactgggctgacatctagaatcacctgccacctggagcctcagtaaaatgcctggggtccctgctgcctctcaatctccagagccatgtccatggggaggtgggctctgaagggcgaaggtgggagagcagggcccctgaggcctgggtatccaaggaggggcacgtgcacctgattctccttggggcccagaggaagctgatgtcatggctggacaaagtcacggagtaaagccagcaaagccaccctcttcctgtgtagtccttacaggcatgactggaaagttggggggcatctatggtagacatggcacagccatgaagagaccagtggggtggtgcagggtggacttggggaccctacccctgaagactgaggccctgcagctaccaggtgggctagaaggtaactggaacaggcctgggcacttgtgcacccatgtaggagcatgagggccacactcttttcacctcaaagcccttgaagagtgggcaaagacagcaagagagctgcagcctgggcccgagctcagaaacagctgtcgcctcagtctgcgcacaggcatgcaccccagggtagtgcctgcagggatgcatgtgtccccgtgggggtgcctgtgccaggcaggcctcaggtgcatgccatgctcagaaccctgctgccctttctaggcagcctccttggggcccaagctctgctccctggatctgccacctagcagacgtggggagcctgaccccatgcctgtcatggaaccctccttgcctggtgtgtgtggctcccctcttcactgggcacctggatccaggcccacctgtgtccctgactcagggtggtcccaggactggcacctactctttagagagccccagcatctttgatgtggattggagacaattgcctggttccctggggcaggtgaagacttggtgccacaaagaatgccacagtggatacgccagcaggccacatggctggccaagcaattattattatggatcccttgggctgtgggccttcccatccaccccaccacaactgcccaggtagctggagctgatcataaa

SEQ ID NO: 172478 - DNA, 3003 bp, Homo sapiens
  Payload ID: 13904
  Gene Symbol: P2RX7
  Gene Name: purinergic receptor P2X, ligand gated ion channel, 7
  ENST ID: ENST00000261826
  CDS Start-End: 42-491
gagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccgtcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccgaagagtgaagggcagtacagtggcttcaagagtccttactgaagccaggcaccgtggctcacgtctgtaatcccagcgctttgggaggccgaggcaggcagatcacctgaggtcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtcccccaaaaaaaaaaaagagtccttaccaatagcaggggctgcagtagccatgttaacatgacatttaccagcaacttgaacttcacctgcaaagctctgtggccacattttcagccaaagggaaatatgctttcatcttctgttgctctctgtgtctgagagcaaagtgacctggttaaacaaaccagaatccctctacatggactcagagaaaagagattgagatgtaagtctcaactctgtccccaggaagttgtgtgaccctaggcctctcacctctgtgcctctgtctccttgttgcccaactactatctcagagatattgtgaggacaaattgagacagtgcacatgaactgtcttttaatgtgtaaagatctacatgaatgcaaaacatttcattatgaggtcagactaggataatgtccaactaaaaacaaacccttttcatcctggctggagaatgtggagaactaaaggtggccacaaattctttgacactcaagtcccccaagacctaagggttttatctcctccccttgaatatgggtggctctgattgctttatccaaaagtggaagtgacattgtgtcagtttcagatcctgatcttaagaggctgacagcttctacttgctgtcccttggaactcttgctatcggggaagccagacgccatttaaaagtctgcctatcctggccaggtgtggtggctcacacctgtaatcccagcactttgggagaccaaggcgggcggatcacttaaagtcaggagtccaagaccagactcgccaacatggtgaaaccgtatctctaataaaaatacaaaaattagctgggcatggtgcgggcacctgtagtcctagctatcaagaggctgagacaggagaaacacttgaacctgggaggtggaggttgcattgagctgagatcgtgccactgcactccaggctgggtgacagagcgagactccatctcaaaaaaaaaaaaaagaaaaa

SEQ ID NO: 172479 - DNA, 5161 bp, Homo sapiens
  Payload ID: 13904
  Gene Symbol: P2RX7
  Gene Name: purinergic receptor P2X, ligand gated ion channel, 7
  Uniprot ID: Q99572
  ENST ID: ENST00000328963
  CDS Start-End: 144-1931
gtcattggaggagcttgaagttaaagactcctgctaaaaaccagtacgtttcattttgcagttactgggagggggcttgctgtggccctgtcaggaagagtagagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccgtcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccgaagagtgaagggcagtacagtggcttcaagagtccttactgaagccaggcaccgtggctcacgtctgtaatcccagcgctttgggaggccgaggcaggcagatcacctgaggtcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtcccccaaaaaaaaaaaagagtccttaccaatagcaggggctgcagtagccatgttaacatgacatttaccagcaacttgaacttcacctgcaaagctctgtggccacattttcagccaaagggaaatatgctttcatcttctgttgctctctgtgtctgagagcaaagtgacctggttaaacaaaccagaatccctctacatggactcagagaaaagagattgagatgtaagtctcaactctgtccccaggaagttgtgtgaccctaggcctctcacctctgtgcctctgtctccttgttgcccaactactatctcagagatattgtgaggacaaattgagacagtgcacatgaactgtcttttaatgtgtaaagatctacatgaatgcaaaacatttcattatgaggtcagactaggataatgtccaactaaaaacaaacccttttcatcctggctggagaatgtggagaactaaaggtggccacaaattctttgacactcaagtcccccaagacctaagggttttatctcctccccttgaatatgggtggctctgattgctttatccaaaagtggaagtgacattgtgtcagtttcagatcctgatcttaagaggctgacagcttctacttgctgtcccttggaactcttgctatcggggaagccagacgccatttaaaagtctgcctatcctggccaggtgtggtggctcacacctgtaatcccagcactttgggagaccaaggcgggcggatcacttaaagtcaggagtccaagaccagactcgccaacatggtgaaaccgtatctctaataaaaatacaaaaattagctgggcatggtgcgggcacctgtagtcctagctatcaagaggctgagacaggagaaacacttgaacctgggaggtggaggttgcattgagctgagatcgtgccactgcactccaggctgggtgacagagcgagactccatctcaaaaaaaaaaaaaagaaaaaaaaaatgtctgcctatcctgagactgccctgctgtgaggaagcccaagcagtcacgtggacagtgcctgaccagccccagctttcaagccatccaagcccagtcaccaaacatgagagagaagaagccttcaggtgattctggactccactaacatatgactgataccgcatgatacatcccaagtgagaactgccccataaatccagaaaaccacattgctatcttaagtccctaagtttggggcttatttgttccacagcaacaggtaactggaacagagggcaagcctgatgaatgggcacacagactcagcccataccttccctggttctaatgttctcagggagcccggaccaaccctgggagcctcaggaacttaggtttccactggacagttctagaagggctatagaccaaatcaggtaactcaccagaccagccttggaatctatcaaatctaactgctgagctacccaatgcattccgatcctcatcacaattctttgactgaaggccgggcgtggtggctcacgcctgtaatcccagcactttgggaggctgaggcgggtggatcacctgaggtcaggagttcgagaccagcctggccaacatggtgagaccctgtctctactaagaatacaaaaattaggtgggtgtggcggtgggcgcctgtaatcccagctacttgggaggctgaggcaggagaatctcttgaacctggaaggtggaggttgcaataagccgagatagtgccactgcactccagcctagataacagagcaagactctgtctcaaaaaacaacaacaacaacaacaaaacaattctatgactgaaagtgactaaaaagctggctttatgccattaacactctgtactttgcagccaatcagaactgacgcagtctgggtgctagctgcttcaaaagcaacccacaccacacttttaccatttccatacatcaactgctgagaatatgaaaatgcacagtgacaggttttaggatcctgcttcaggatttccttttcctggtttggtcactagagttggctatttatctgtttctaaacaatagctattttatcgaatagtttagagaccactattaaatattgtgactgatgaaggatctgtgaatttttttatatatgttctaagagttaccattttgataccttttaaaaaccagcagctttctactatattcatgtaagacagcatgaataaaaccattttttgatacagggttttatttggctttaaactcaggaaccaagttaattatgccagattgaactttgatttttactaccttttcaaagatattttaaaaagtggattactacatatgatttctttggagcttacatttctttacttcacgaattctatgtcactgttacaagtttccattctgatggcttctgggcctttgtacctttgtttttggtgccttattcctagtatgtttctatcaccttaatgaggccgcagatggagtcagaatgtgaaattacaaataatcactggatccatctactgttttccatcaccttccccactgatgctctgggcgagagagtgatgtgtcacttcaactgtgtgtaatatgtcagacacgtcctacaataacaggcgtcatatttgtattatttttagtttactgtagaaaataatgtcaccgccaaaggtgatgagagtcacgttttgtaggatctgttttcttatacttaaagacagacttctgctacggtaattgccagtattcatggcttcctttctgtgtcagaagagaagggatctgctttctcttggctgatttcacatagcattggtaatagacatgcatttctctttctaaaggggagtaactttttaaacccttcctgattttagcctggcaatgtaagtgtccttaatgtgactgttttgataattaaaaaaaggtatataattta

SEQ ID NO: 172480 - DNA, 1799 bp, Homo sapiens
  Payload ID: 13904
  Gene Symbol: P2RX7
  Gene Name: purinergic receptor P2X, ligand gated ion channel, 7
  Uniprot ID: Q99572
  ENST ID: ENST00000541716
  CDS Start-End: 1-387
atgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccgtcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggtaagagattctcttttccatgctttaggaaaatggtttggagaaggaagtgactaacgcagcgcttgtctgcattctccccaggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccgaagagtgaagggcagtacagtggcttcaagagtccttactga

SEQ ID NO: 172481 - DNA, 2134 bp, Homo sapiens
  Payload ID: 13904
  Gene Symbol: P2RX7
  Gene Name: purinergic receptor P2X, ligand gated ion channel, 7
  ENST ID: ENST00000537312
  CDS Start-End: 153-296
aactctgcagtcattggaggagcttgaagttaaagactcctgctaaaaaccagtacgtttcattttgcagttactgggagggggcttgctgtggccctgtcaggaagagtagagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccgtcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggtaagagattctcttttccatgctttaggaaaatggtttggagaaggaagtgactaacgcagcgcttgtctgcattctccccaggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccgaagagtgaagggcagtacagtggcttcaagagtccttactgaagccaggcaccgtggctcacgtctgtaatcccagcgctttgggaggccgaggcaggcagatcacctgaggtcgggagttggagacccgcctggctaacaaggcgaaatcctgtctgtactaaaaatacaaaaatcagccagacatggtggcatgcacctgcaatcccagctactcgggaggctgaggcacaagaatcacttgaacccgggaggcagaggttgtagtgagcccagattgtgccactgctctccagcctgggaggcacagcaaactgtccc

SEQ ID NO: 172482 - DNA, 1927 bp, Homo sapiens
  Payload ID: 13904
  Gene Symbol: P2RX7
  Gene Name: purinergic receptor P2X, ligand gated ion channel, 7
  ENST ID: ENST00000538011
  CDS Start-End: 1-384
atgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcagctttttagacgcacagccaccaagccagcaaggtctgccgagattcagaaggacagagaactttctaccaaagagcaccagcccttctagattgtgtagcatttcatcaacaaaaatgactccaggagaccattcttgggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccgtcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccgaagagtgaagggcagtacagtggcttcaagagtccttactga

SEQ ID NO: 172483 - DNA, 546 bp, Homo sapiens
  Payload ID: 13904
  Gene Symbol: P2RX7
  Gene Name: purinergic receptor P2X, ligand gated ion channel, 7
  ENST ID: ENST00000535928
  CDS Start-End: 120-263
agactcctgctaaaaaccagtacgtttcattttgcagttactgggagggggcttgctgtggccctgtcaggaagagtagagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggatgggcttgatggaagctgaagctgcgtgggttggaaagcctggtcaaagcctagtctctcgcccgggttgagttaatgatgtccctcctggagaacgtcctctccgcagttctttcacatctgtggttctacgatgctttgacccctataggaattca

SEQ ID NO: 172484 - DNA, 1578 bp, Homo sapiens
  Payload ID: 13904
  Gene Symbol: P2RX7
  Gene Name: purinergic receptor P2X, ligand gated ion channel, 7
  Uniprot ID: Q99572
  ENST ID: ENST00000541022
  CDS Start-End: 1-387
atgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccgaagagtgaagggcagtacagtggcttcaagagtccttactga

SEQ ID NO: 172485 - DNA, 1605 bp, Homo sapiens
  Payload ID: 13904
  Gene Symbol: P2RX7
  Gene Name: purinergic receptor P2X, ligand gated ion channel, 7
  Uniprot ID: Q99572
  ENST ID: ENST00000535600
  CDS Start-End: 1-828
atgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggtaagagattctcttttccatgctttaggaaaatggtttggagaaggaagtgactaacgcagcgcttgtctgcattctccccaggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccgaagagtgaagggcagtacagtggcttcaagagtccttactga

SEQ ID NO: 172486 - DNA, 1872 bp, Homo sapiens
  Payload ID: 13904
  Gene Symbol: P2RX7
  Gene Name: purinergic receptor P2X, ligand gated ion channel, 7
  Uniprot ID: Q99572
  ENST ID: ENST00000535250
  CDS Start-End: 1-1095
atgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccgtcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggtaagagattctcttttccatgctttaggaaaatggtttggagaaggaagtgactaacgcagcgcttgtctgcattctccccaggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccgaagagtgaagggcagtacagtggcttcaagagtccttactga

SEQ ID NO: 172487 - DNA, 1651 bp, Homo sapiens
  Payload ID: 13904
  Gene Symbol: P2RX7
  Gene Name: purinergic receptor P2X, ligand gated ion channel, 7
  ENST ID: ENST00000541564
  CDS Start-End: 1-777
atgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcaggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccgaagagtgaagggcagtacagtggcttcaagagtccttactga

SEQ ID NO: 172488 - DNA, 2011 bp, Homo sapiens
  Payload ID: 13904
  Gene Symbol: P2RX7
  Gene Name: purinergic receptor P2X, ligand gated ion channel, 7
  ENST ID: ENST00000539606
  CDS Start-End: 1-384
atgccggcctgctgcagctgcagtgatgttttccagtatgagacgaacaaagtcactcggatccagagcatgaattatggcaccattaagtggttcttccacgtgatcatcttttcctacgtttgctttgctctggtgagtgacaagctgtaccagcggaaagagcctgtcatcagttctgtgcacaccaaggtgaaggggatagcagaggtgaaagaggagatcgtggagaatggagtgaagaagttggtgcacagtgtctttgacaccgcagactacaccttccctttgcagctttttagacgcacagccaccaagccagcaaggtctgccgagattcagaaggacagagaactttctaccaaagagcaccagcccttctagattgtgtagcatttcatcaacaaaaatgactccaggagaccattcttgggggaactctttcttcgtgatgacaaactttctcaaaacagaaggccaagagcagcggttgtgtcccgagtatcccacccgcaggacgctctgttcctctgaccgaggttgtaaaaagggatggatggacccgcagagcaaaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgataatttttcagatgtggcaattcagggcggaataatgggcattgagatctactgggactgcaacctagaccgttggttccatcactgccgtcccaaatacagtttccgtcgccttgacgacaagaccaccaacgtgtccttgtaccctggctacaacttcagatacgccaagtactacaaggaaaacaatgttgagaaacggactctgataaaagtcttcgggatccgttttgacatcctggtttttggcaccggaggaaaatttgacattatccagctggttgtgtacatcggctcaaccctctcctacttcggtctggtaagagattctcttttccatgctttaggaaaatggtttggagaaggaagtgactaacgcagcgcttgtctgcattctccccaggccgctgtgttcatcgacttcctcatcgacacttactccagtaactgctgtcgctcccatatttatccctggtgcaagtgctgtcagccctgtgtggtcaacgaatactactacaggaagaagtgcgagtccattgtggagccaaagccgacattaaagtatgtgtcctttgtggatgaatcccacattaggatggtgaaccagcagctactagggagaagtctgcaagatgtcaagggccaagaagtcccaagacctgcgatggacttcacagatttgtccaggctgcccctggccctccatgacacacccccgattcctggacaaccagaggagatacagctgcttagaaaggaggcgactcctagatccagggatagccccgtctggtgccagtgtggaagctgcctcccatctcaactccctgagagccacaggtgcctggaggagctgtgctgccggaaaaagccgggggcctgcatcaccacctcagagctgttcaggaagctggtcctgtccagacacgtcctgcagttcctcctgctctaccaggagcccttgctggcgctggatgtggattccaccaacagccggctgcggcactgtgcctacaggtgctacgccacctggcgcttcggctcccaggacatggctgactttgccatcctgcccagctgctgccgctggaggatccggaaagagtttccgaagagtgaagggcagtacagtggcttcaagagtccttactga

SEQ ID NO: 172489 - DNA, 520 bp, Homo sapiens
  Payload ID: 13904
  Gene Symbol: P2RX7
  Gene Name: purinergic receptor P2X, ligand gated ion channel, 7
  ENST ID: ENST00000545434
  CDS Start-End: 43-186
agagctctggtccagctccgcgcagggagggaggctgtcaccatgccggcctgctgcagctgcagtgatgttttccagtatgagacgaacaaagtcactcggatccagagcatgaattatggcaccattaagtggttcttccacgtgatcatcttttcctacgtttggggaactctttcttcgtgatgacaaactttctcaaaacagaaggccaagagcagcggttgtgtcccgaggaattcagaccggaaggtgtgtagtgtatgaagggaaccagaagacctgtgaagtctctgcctggtgccccatcgaggcagtggaagaggccccccggcctgctctcttgaacagtgccgaaaacttcactgtgctcatcaagaacaatatcgacttccccggccacaactacaccacgagaaacatcctgccaggtttaaacatcacttgtaccttccacaagactcagaatccacagtgtcccattttccgactaggagacatcttccgagaaacaggcgat

SEQ ID NO: 172490 - DNA, 6747 bp, Homo sapiens
  Payload ID: 13905
  Gene Symbol: P2RY1
  Gene Name: purinergic receptor P2Y, G-protein coupled, 1
  Uniprot ID: P47900
  ENST ID: ENST00000305097
  CDS Start-End: 1091-2212
acctggcgtggttctcgagggccctagaggctcctgctacggactggtcggctctggggttgtaggcagaaggctctaagcggtcggaagggtttcctgtgtgtcagcaacttcactttgccgagatagctggcggaagagggaaggagcgctcgcgggccaatcgcctgccagcagccaccttggagcgcacccctctccctcgccgccgactccggtagcagcgtgccggcagaggctgaacacactcggcctcggcggagacctgctccccagaagacgcctcctgcttcccactgcgccctggaggacgcgggctggctgctgggcgagctcggcggaggcacgcccctcgcctccccgcggagtgcggactcgccccggtgcccaaactccgcccaccctctagggagctccgctctcccgcctaaccccggcactccggacagagctgggcctggggaaggggttcctgaactacgcggacgccgaacgggacgcgctgcagaagcgcacgagtctgcggccacgcgcgctccgatggctgccaggagctgagctcagggtgggcggaggaagcggttagacgccccgaaactgagctgcacgtttctaaggtagggaggaggaagatgcccccaattaagttgatctttgagccaaggaggctggggagcagcctccccaagctagagccctgcagagcgagtttcccttgacctcgctgcgcctctggcgcgctctgcagcgcggacccgcggcccctcgggaaagcgcagtcggaaagttatccgcggcggttccctgcgcgccctgttgtgtaagctcggcgttgccagcggacggagaagttgctggcttgcccgatagcccagttcggtggcggcccggggcggatttcatggcccgcggcgaacgcggggccagagctggcgtgggcgagcccctgcgcgccccctcccgcggggatccagttcgcctgctcccttccgctcgctggcttttccgatgcttgctgcgcccctggccgccgctgccctctcgccgcctcctacccctcggagccgccgcctaagtcgaggaggagagaatgaccgaggtgctgtggccggctgtccccaacgggacggacgctgccttcctggccggtccgggttcgtcctgggggaacagcacggtcgcctccactgccgccgtctcctcgtcgttcaaatgcgccttgaccaagacgggcttccagttttactacctgccggctgtctacatcttggtattcatcatcggcttcctgggcaacagcgtggccatctggatgttcgtcttccacatgaagccctggagcggcatctccgtgtacatgttcaatttggctctggccgacttcttgtacgtgctgactctgccagccctgatcttctactacttcaataaaacagactggatcttcggggatgccatgtgtaaactgcagaggttcatctttcatgtgaacctctatggcagcatcttgtttctgacatgcatcagtgcccaccggtacagcggtgtggtgtaccccctcaagtccctgggccggctcaaaaagaagaatgcgatctgtatcagcgtgctggtgtggctcattgtggtggtggcgatctcccccatcctcttctactcaggtaccggggtccgcaaaaacaaaaccatcacctgttacgacaccacctcagacgagtacctgcgaagttatttcatctacagcatgtgcacgaccgtggccatgttctgtgtccccttggtgctgattctgggctgttacggattaattgtgagagctttgatttacaaagatctggacaactctcctctgaggagaaaatcgatttacctggtaatcattgtactgactgtttttgctgtgtcttacatccctttccatgtgatgaaaacgatgaacttgagggcccggcttgattttcagaccccagcaatgtgtgctttcaatgacagggtttatgccacgtatcaggtgacaagaggtctagcaagtctcaacagttgtgtggaccccattctctatttcttggcgggagatactttcagaaggagactctcccgagccacaaggaaagcttctagaagaagtgaggcaaatttgcaatccaagagtgaagacatgaccctcaatattttacctgagttcaagcagaatggagatacaagcctgtgaaggcacaagaatctccaaacacctctctgttgtaatatggtaggatgcttaacagaatcaagtacttttcccctctttaactttctagtttagaaaaaaatcaaaccaagaaaatagtgagttaaaaaaataatagaagtagaaatgcccacatccacacttagcttgtttgggtttgctttcacagtctctcttccttctgactagaagtatgtataataaaacaatactacctagttaaacatttactttctcttttgcctttaaaatgtgcaggcttttctgtttaaagtgtgtgtgcacatgagtactggggctgtttttgatattagtaatttctctaagaaaactagccccctgcaacttgagtttgtggtttatctagcctttattgtttttttaaaatccacagtaggaataaaaaatctatattctcagaaatatctagcatggtatataacaaaacactaaactcatcagttcatccggcatcagatcaatggatctctgagcggggtgtttttttcagtgtcttataagcatagatgatagttgactgagtttctttagggcattgaatagacaagtaaagctaatgaatttaaaagcctgaaaagtgattgttttccagttatttctggaaaaggtctcattatatattgggtgctaaatgtttgatggggaaagcctgcatatattatcgtactggtaaaatgcattcaaaataattaaagtgcatgtattttccttgtaaacaccatgagctctcttagacatcttgtgataaagagcatttacttgccccactgctgtgcaatgccttaggactttgtttgtgttccaggacaagtgttcactcacatctgtaaaaacaattttaagaattgcaaataaattacagaccaaagattgagtaaagtcaaataactgttagtaagttgaaggatattggacaggaggacagtatttcagaaaaggagaggttgacagtcatccacaaggcatagcctccaagtatactctcaaatgtatgaagcaactggggtgggcagaagacattttagaatgagggctttagtttaaattaaagtcatggtggagaagactcttgcttcctccaagtgtttgaaaacacaaaatgcgatatgaaaagaagaaatagaatttgtataggttgcattgatagaatgggaagctataatctttgaataaaccttacatctcaatatttaaagaaaaaacatatatatggagggaaatatagagaattaaagtacctagatgccatagcactgaaaagtaaagtactactcaaactactaatagaagactattggtcagtgttttctattatatttgttctctgccaggtgttaatgaaaaatttgtaaaatgcttcaacagtgttaataattttaatgaatattgaattgctgcatgtctagtccttgaaatggtcaaattctatataatgagaataacaaggtgagataatgcaattgacaatcccaaacaaatccagtgtcaaaggaatttttagttttggaagctatccctcataaagtcaacatcagagtttgcaactgatggtggcataacttgtttgaaagcactttacaagtagagcaacatggggctgtatgttaaggcaagaaagaaccttagtgccccgtggaccataatgacaggaaattttcaggtcttgatttcagttcttgcaatgcctatgtagattgaggatttgtgagaccttcagagtagcttcactttacccaatctctggccactaagatcaatgaagaaaagctgtatttaaccttccaaagcagtgattctttttacatgttcagttttaatgcataggattatagaaaccaaatcaagaagaaacctactacacctccttattttgaggaaagagagggttagcaaagttctcacttcatcaggctcaaataacatccgttttagattcctacaagacaaaatctaaaatatgtcattactttattgaccttgttaaacaagatcaatatcattaaactgaccaagatggaaattacaggacttgtaccagacttgaacttgtagcctaatgatacacatttttacaatatttcttcaccatttagttttctttcttttaggtctcaggatgctcagcttaatttagagtatgtgttaagtacattgtttcagcgtccagagaattttgtgagtgtggatccagtgaggaggtgaacagtaactagaaatgcttgtttactacttggcatgttttttccaaagtgtttcttctttagcttcatacatcacatatggacactgatgacatgtgaatgcatgccacatagtaacaagaatgatcttgccaactccttccaagccaaaagaagcctctgggaaggtgtgccaatggtgaaaacgtacagagggtcagggtgaagcagtgatctctattggctgaaaaactgatcaggtcatatgatgattgaagtatgtttattgtaagggcagaaatgtgttggcatttggataaaaaactgctaacattatagaacttattacctaacaaaatttcacaccacaaaaaatattttaatggcaaattcaaggtgttttattgcttacaaatcagcatctttgactctttgaacatcaatttgtgtttacattgaaatgacaaaaagacaaactaagaagaaatacagcatgcaagttggaattcagagttaaaaccatgatgttgccgctcagccagctatgtgactgttgaccctttcaagaacacacatggatttaaaagttggatgacatccattgttggggccttgggggatatggtaaagcatgaaaactaaacagccaggagcctgtgaaatctgctactgtattttccaggacttcattccactccttggctaaaaaaatcttggaagtttcacagattatgatgtggacctgtcacctgtaaattgtctcaatctactcagacaagacactaaactgtctttggatactatagatgtcagtgcttatagcagctggaatttggctagtgacaatgtttaaagatgtaatactagttagtatctattgaagcttaaactttgctggtcaggttgtagctattgtaaaagtatttattgaagaagctcacagtccttcagttgtacagactgaaaaactttcatgaaagatccaacatactaatgtaaattatatttattacaatgtatgatattaatgtgtcaaactggtgtattttacaaaatatataatgcatacataaataagagttgtatattacagtgcttttcaaatatcagtgtcttggaatatttaagtcttcacattttttggtctaaaatatgaaaatgtttcatgatacaagtgattaattttccctagtagtgcttttgcatgtttgcctttttatttaagtttttttctatatagacacaatttggtgtcagactatcataagatcgatagtgaatataaaatatcttagccaaatggggtctgtattgtctacattttatatattaaataaaagtttttgttgtcttttcaggaggtttagagtattgtcactaaatatgatcaaagcttccctttccaaatgcaaaagtcttgtcctacatttaaagttgatctgtcatgttttagcagtcaagtgggatgggcattatataaacaacgttacaatgtaaggaaaatctttaaggagatggggagagaaaaaggcagctggtataatcggttactgctgcttagttctacttaattttttgtgttgcttcttcttaaggtgagatagcataatcttaactgttttgagatggaattttaaagtaacacactaccagcgagttcaacactgctattgattttaatctgtttttttttgtttagttgataacttaaattccaagtttcatagtgataattgtatattatttggctgctgaattctgttagagttttttattctgttgtacattgtattatacacataatcacaaattaatatgaaggtgaatatatgttacatatcaaaatttgtgaatttgaattatagtatgttttagtgctattgcaaaaaatgtttatttttatattatctgtgattttaatatagatgattgaactagatttctttttgagtgatagtgccattgaatgagcagtatggaaacagtgttacttgatattttgagctttctcaggtttatctaaatcagtggtagcttaacaaaacccagactaattgtgtgtaattgtatttttaataaaaggaaagtacatttcctataatagcatagtactgtttgcatgtaagagtatgcaaaaccttgtgtgtgtgtgtgtgtgtgtgtgtgtgtgtgtgtcttagtgtgtgtaaggcatggcagccaactttgtatctgctatttttagtacgagcagagcttcataattgtggtcactagaactgtacttaccatggacagttaaaactgaaaaagactcaataaaactatgaaacatgg

SEQ ID NO: 172491 - DNA, 1714 bp, Homo sapiens
  Payload ID: 13906
  Gene Symbol: P2RY10
  Gene Name: purinergic receptor P2Y, G-protein coupled, 10
  Uniprot ID: O00398
  ENST ID: ENST00000171757
  CDS Start-End: 281-1300
tgccgccagagtaaagctttctaccctttactccctgcaaagaaacaagagtgcttatcccagctaagctccagggtaatgttatcatgacagcttcaacttttagaccacaggcaaatgctttgttaaaactctatgctggtcattcccttcaggatttggcactcaccaacatacccttctttcaagtgaaaaggcatctcttttaatggtcctgacctttggaataggaagcatgtaccctggacagagcacttcaaactagaggaaccataaatccatggctaaccttgacaaatacactgaaacattcaagatgggtagcaacagtaccagcactgctgagatttactgtaatgtcactaatgtgaaatttcaatactccctctatgcaaccacctatatcctcatattcattcctggtcttctggctaacagtgcagccttgtgggttctgtgccgcttcatcagcaagaaaaataaagccatcattttcatgatcaacctctctgtggctgaccttgctcatgtattatctttacccctccggatttactattacatcagccaccactggcctttccagagagccctttgcctgctctgcttctacctgaagtatctcaacatgtatgccagcatttgtttcctgacgtgcatcagtcttcaaaggtgcttttttctcctcaagcccttcagggccagagactggaagcgtaggtacgatgtgggcatcagtgctgccatctggatcgttgtggggactgcctgtttgccatttcccatcctgagaagcacagacttaaacaacaacaagtcctgctttgctgatcttggatacaagcaaatgaatgcagttgcgttggtcgggatgattacagttgctgagcttgcaggatttgtgatcccagtgatcatcatcgcatggtgtacctggaaaactactatatccttgagacagccaccaatggctttccaagggatcagtgagaggcagaaagcactgcggatggtgttcatgtgtgctgcagtcttcttcatctgcttcactccctatcatattaactttattttttacaccatggtaaaggaaaccatcattagcagttgtcccgttgtccgaatcgcactgtatttccaccctttttgcctgtgccttgcaagtctctgctgccttttggatccaattctttattactttatggcttcagagtttcgtgaccaactatcccgccatggcagttctgtgacccgctcccgcctcatgagcaaggagagtggttcatcaatgattggctaaaattaagatatctctttaattacgcctttgtttacctacgttccttgtctttttccaaaggccagaattgtcaaccaatttctttaattgaacattgtaaaaaacaggaataagtacttttgtgtaatattcacagtcaacaggggtgtgatggtgaaggcagagtgtgaaaaacgtgagagaggaagagaaaatagatttacctgattcctctttaaaattcaagccactttcttatttaagaaacctagatcaagtttttacagatgtaaataaaagttgaatagtttaccttaaatttttttcaataagtaagttattgttaataatgcacagtaaatatgtgaatttttcctagatgtaaaaaaaaaaatctttcatataaagaccttaaattctgagtgagagtaaaaa

SEQ ID NO: 172492 - DNA, 1597 bp, Homo sapiens
  Payload ID: 13906
  Gene Symbol: P2RY10
  Gene Name: purinergic receptor P2Y, G-protein coupled, 10
  Uniprot ID: O00398
  ENST ID: ENST00000544091
  CDS Start-End: 178-1197
tttgtgcaaataaggtttctgtggtgagacaccagataaactcaacttcctctttcaacaacaaatgtgtcagttatcagcaggatccatgccgccagagtaaagctttctaccctttactccctgcaaagaaacaagagtgcttatcccagctaagctccagggaaccataaatccatggctaaccttgacaaatacactgaaacattcaagatgggtagcaacagtaccagcactgctgagatttactgtaatgtcactaatgtgaaatttcaatactccctctatgcaaccacctatatcctcatattcattcctggtcttctggctaacagtgcagccttgtgggttctgtgccgcttcatcagcaagaaaaataaagccatcattttcatgatcaacctctctgtggctgaccttgctcatgtattatctttacccctccggatttactattacatcagccaccactggcctttccagagagccctttgcctgctctgcttctacctgaagtatctcaacatgtatgccagcatttgtttcctgacgtgcatcagtcttcaaaggtgcttttttctcctcaagcccttcagggccagagactggaagcgtaggtacgatgtgggcatcagtgctgccatctggatcgttgtggggactgcctgtttgccatttcccatcctgagaagcacagacttaaacaacaacaagtcctgctttgctgatcttggatacaagcaaatgaatgcagttgcgttggtcgggatgattacagttgctgagcttgcaggatttgtgatcccagtgatcatcatcgcatggtgtacctggaaaactactatatccttgagacagccaccaatggctttccaagggatcagtgagaggcagaaagcactgcggatggtgttcatgtgtgctgcagtcttcttcatctgcttcactccctatcatattaactttattttttacaccatggtaaaggaaaccatcattagcagttgtcccgttgtccgaatcgcactgtatttccaccctttttgcctgtgccttgcaagtctctgctgccttttggatccaattctttattactttatggcttcagagtttcgtgaccaactatcccgccatggcagttctgtgacccgctcccgcctcatgagcaaggagagtggttcatcaatgattggctaaaattaagatatctctttaattacgcctttgtttacctacgttccttgtctttttccaaaggccagaattgtcaaccaatttctttaattgaacattgtaaaaaacaggaataagtacttttgtgtaatattcacagtcaacaggggtgtgatggtgaaggcagagtgtgaaaaacgtgagagaggaagagaaaatagatttacctgattcctctttaaaattcaagccactttcttatttaagaaacctagatcaagtttttacagatgtaaataaaagttgaatagtttaccttaaatttttttcaataagtaagttattgttaataatgcacagtaaatatgtgaatttttcctagatgtaaaaaaaaaaatctttcatataaagaccttaaattctg

SEQ ID NO: 172493 - DNA, 1943 bp, Homo sapiens
  Payload ID: 13907
  Gene Symbol: P2RY11
  Gene Name: purinergic receptor P2Y, G-protein coupled, 11
  Uniprot ID: Q96G91
  ENST ID: ENST00000321826
  CDS Start-End: 185-1309
gaacctcaggagggttgtggcacaatgaggaaggaaacgtgggtggaaaggcacgctggcctgctctgctggctgggccagtaactggggatggggctggggcagggcccactaagccactggtgactgggggaggggctggggaactgggtagcagacacaggctgaggatcggcacgggagcatggcagccaacgtctcgggtgccaagtcctgccctgccaacttcttggcagctgccgacgacaaactcagtgggttccagggggacttcctgtggcccatactggtggttgagttcctggtggccgtggccagcaatggcctggccctgtaccgcttcagcatccggaagcagcgcccatggcaccccgccgtggtcttctctgtccagctggcagtcagcgacctgctctgcgccctgacgctgcccccgctggccgcctacctctatccccccaagcactggcgctatggggaggccgcgtgccgcctggagcgcttcctcttcacctgcaacctgctgggcagcgtcatcttcatcacctgcatcagcctcaaccgctacctgggcatcgtgcaccccttcttcgcccgaagccacctgcgacccaagcacgcctgggccgtgagcgctgccggctgggtcctggccgccctgctggccatgcccacactcagcttctcccacctgaagaggccgcagcagggggcgggcaactgcagcgtggccaggcccgaggcctgcatcaagtgtctggggacagcagaccacgggctggcggcctacagagcgtatagcctggtgctggcggggttgggctgcggcctgccgctgctgctcacgctggcagcctacggcgccctcgggcgggccgtgctacgcagcccaggcatgactgtggccgagaagctgcgtgtggcagcgttggtggccagtggtgtggccctctacgccagctcctatgtgccctaccacatcatgcgggtgctcaacgtggatgctcggcggcgctggagcacccgctgcccgagctttgcagacatagcccaggccacagcagccctggagctggggccctacgtgggctaccaggtgatgcggggcctcatgcccctggccttctgtgtccaccctctactctacatggccgcagtgcccagcctgggctgctgctgccgacactgccccggctacagggacagctggaacccagaggacgccaagagcactggccaagccctgcccctcaatgccacagccgcccctaaaccgtcagagccccagtcccgtgagctgagccaatgatgtggcctagcggaagctgcctcctcaccctaggtgttgctggagaaccctgagggcagggcccgagccccgacacatcccttcccccaaaaagcaacacctgtgcttgcagccaggtcaggcccagctgcagcccaggcaggagcagtcgcctttcccacccacagcgctggccacagggctccctgcagggtcagggaccagaccacgcccagaggaggggaggcactggcccccgccacaggactggagacgcaagaacaaaaagaaccaagtagagagagtggagctgctttattgcccttggagcccgcgctctcggaggctgtcttctgtcgccaagggtcccggaccgagtacacagtggcagctggcttagttggtggacggcctggggtaggggagggtggcaggtataagacttctgggggcaccccaagaccccagacacccaagtggcatcttgggggtgggtgggcagaggacggggtaatgtgaggacgaagcgggcacggagccagatggccagtctccaggcctggtccacggactggcagggaccccaggcacaagagctgccacccctctgcccggttttggaaaaaaacaataaaggactgtcccctcaaaacca

SEQ ID NO: 172494 - DNA, 1766 bp, Homo sapiens
  Payload ID: 13908
  Gene Symbol: P2RY12
  Gene Name: purinergic receptor P2Y, G-protein coupled, 12
  Uniprot ID: Q9H244
  ENST ID: ENST00000302632
  CDS Start-End: 301-1329
actgttgttacacaacaaacatcatagtgctgaaatgacaaaaatccagggtagtgatcacaatcagaagacaggagctgcagaacagaacactttctcatgtccagggtcagattacaagagcactcaagactttactgacgaaaactcaggaaatcctctatcacaaagaggtttggcaactaaactaagacattaaaaggaaaataccagatgccactctgcaggttgcaataactactacttactggatacattcaaaccctccagaatcaacagttatcaggtaaccaacaagaaatgcaagccgtcgacaacctcacctctgcgcctggtaacaccagtctgtgcaccagagactacaaaatcacccaggtcctcttcccactgctctacactgtcctgttttttgttggacttatcacaaatggcctggcgatgaggattttctttcaaatccggagtaaatcaaactttattatttttcttaagaacacagtcatttctgatcttctcatgattctgacttttccattcaaaattcttagtgatgccaaactgggaacaggaccactgagaacttttgtgtgtcaagttacctccgtcatattttatttcacaatgtatatcagtatttcattcctgggactgataactatcgatcgctaccagaagaccaccaggccatttaaaacatccaaccccaaaaatctcttgggggctaagattctctctgttgtcatctgggcattcatgttcttactctctttgcctaacatgattctgaccaacaggcagccgagagacaagaatgtgaagaaatgctctttccttaaatcagagttcggtctagtctggcatgaaatagtaaattacatctgtcaagtcattttctggattaatttcttaattgttattgtatgttatacactcattacaaaagaactgtaccggtcatacgtaagaacgaggggtgtaggtaaagtccccaggaaaaaggtgaacgtcaaagttttcattatcattgctgtattctttatttgttttgttcctttccattttgcccgaattccttacaccctgagccaaacccgggatgtctttgactgcactgctgaaaatactctgttctatgtgaaagagagcactctgtggttaacttccttaaatgcatgcctggatccgttcatctattttttcctttgcaagtccttcagaaattccttgataagtatgctgaagtgccccaattctgcaacatctctgtcccaggacaataggaaaaaagaacaggatggtggtgacccaaatgaagagactccaatgtaaacaaattaactaaggaaatatttcaatctctttgtgttcagaactcgttaaagcaaagcgctaagtaaaaatattaactgacgaagaagcaactaagttaataataatgactctaaagaaacagaagattacaaaagcaattttcatttacctttccagtatgaaaagctatcttaaaatatagaaaactaatctaaactgtagctgtattagcagcaaaacaaacgacatccaattgtcatgctgcatgcaaaactacacagaattcatgttttgcagagttttgccaaaatgagtaatcatataatatttactgtaatttttaaaatacattatcgttcacaattttattttttcataatcaactaaggaagaacgatcaattggatataatcttcttaccaaaaatgatagttaaaatgtatatatatcctagt

SEQ ID NO: 172495 - DNA, 2764 bp, Homo sapiens
  Payload ID: 13909
  Gene Symbol: P2RY13
  Gene Name: purinergic receptor P2Y, G-protein coupled, 13
  Uniprot ID: Q9BPV8
  ENST ID: ENST00000325602
  CDS Start-End: 21-1085
ctcatttgtaggctgaactaatgactgccgccataagaagacagagagaactgagtatcctcccaaaggtgacactggaagcaatgaacaccacagtgatgcaaggcttcaacagatctgagcggtgccccagagacactcggatagtacagctggtattcccagccctctacacagtggttttcttgaccggcatcctgctgaatactttggctctgtgggtgtttgttcacatccccagctcctccaccttcatcatctacctcaaaaacactttggtggccgacttgataatgacactcatgcttcctttcaaaatcctctctgactcacacctggcaccctggcagctcagagcttttgtgtgtcgtttttcttcggtgatattttatgagaccatgtatgtgggcatcgtgctgttagggctcatagcctttgacagattcctcaagatcatcagacctttgagaaatatttttctaaaaaaacctgtttttgcaaaaacggtctcaatcttcatctggttctttttgttcttcatctccctgccaaatacgatcttgagcaacaaggaagcaacaccatcgtctgtgaaaaagtgtgcttccttaaaggggcctctggggctgaaatggcatcaaatggtaaataacatatgccagtttattttctggactgtttttatcctaatgcttgtgttttatgtggttattgcaaaaaaagtatatgattcttatagaaagtccaaaagtaaggacagaaaaaacaacaaaaagctggaaggcaaagtatttgttgtcgtggctgtcttctttgtgtgttttgctccatttcattttgccagagttccatatactcacagtcaaaccaacaataagactgactgtagactgcaaaatcaactgtttattgctaaagaaacaactctctttttggcagcaactaacatttgtatggatcccttaatatacatattcttatgtaaaaaattcacagaaaagctaccatgtatgcaagggagaaagaccacagcatcaagccaagaaaatcatagcagtcagacagacaacataaccttaggctgacaactgtacatagggttaacttctatttattgatgagacttccgtagataatgtggaaatcaaatttaaccaagaaaaaaagattggaacaaatgctctcttacattttattatcctcgtgtacagaaaagattatataaaatttaaatccacatagatctattcataagctgaatgaaccattactaagagaatgcaacaggatacaaatggccactagaggtcattatttctttctttctttttttttttttttaatttcaagagcatttcactttaacattttggaaaagactaaggagaaacgtatatccctacaaacctcccctccaaacaccttctcacattcttttccacaattcacataacactactgcttttgtgccccttaaatgtagatatgtgctgaaagaaaaaaaaaacgcccaactcttgaagtccattgctgaaaactgcagccaggggttgaaagggatgcagacttgaagagtctgaggaactgaagtgggtcagcaagacctctgaaatcctgggtaaaggattttctccttacaattacaaacagcctctttcacattacaataatataccataggaggcacaagcaccattattaagccactttgcttacaccttaagtgtgtacaattcaagtgtgagaatgctgtgttaactattctttggaattctccttctgtccagcaaatactctaatgatggttaaacatggcacctactcagcaatgccttcctggaccacaacccctatccccctgccccaccctcctcattaaaaacaaatacttctactgtttgggtgtgtgatagggttctcaatgcagatctcccttttctagttagctatattcttgactgcatccgctaaaaatgttaaagcttcttgagagacagacatgccagattttcttggtatctcccataatacgacctacagtccatggtctacagatgttttaaatagaattgctattctcgatacatacaaagacgtaattgctgacccacaatcagtaacatccatattgagagatttttcaaaggatggtgaccctgcttgtatttatttaccttggtattttttcttgcatccttctgtgattcaaaaaagtaaaatgtggctttctgaaatgatggataagagtctacatcttctagaaaaaatacataaaggagtagttaagctctgtaaatgtgccacgagctccaacacgaccatcgtagggtgaagcccacgttttcttccatggcctcaaaggccctagaacttgcctacctttctggccttacctcctagctacttatccatctcttgaactttatactcttgtataaatttctaactttcagaaaatgccatactctgttttggcaccacacatgtatatttccccctggtacacttggaagactcttatccatctgtgaaaccctatgttgtcatcacttggtccatgaaatattacctggccaatatcccaccatcacctcaaacccaatcaccccctcctctgtatgctgtcacacctatattattaaacttatcacattgcattgtaattacttcctgacctttgtatctactcttttagtaactgatgtatatatctgaaaggagagattgtttcattgtgcaatcaataaatgtttgataaaataaa

SEQ ID NO: 172496 - DNA, 2513 bp, Homo sapiens
  Payload ID: 13910
  Gene Symbol: P2RY14
  Gene Name: purinergic receptor P2Y, G-protein coupled, 14
  Uniprot ID: Q15391
  ENST ID: ENST00000309170
  CDS Start-End: 314-1330
aattctatctgacaacagcagcagagggacccactatcttgtggtttctgtcaagttcctgattttcatccgtagttgaagatgagcaagaactctgtaacagtgttaccttggagcctacaatgagaggtatttcaaaatgagtgaagcatgactctcacagatgaaggcctagacgcaggatctttaatgaaaaaacacttgggccacttcaagacgacaaacgctcactgggcaaaacaccttcactgaaaagagacctcatattatgcaaaaaaaatcttaaaaggcctctgccttcagaagttacaagatgatcaattcaacctccacacagcctccagatgaatcctgctctcagaacctcctgatcactcagcagatcattcctgtgctgtactgtatggtcttcattgcaggaatcctactcaatggagtgtcaggatggatattcttttacgtgcccagctctaagagtttcatcatctatctcaagaacattgttattgctgactttgtgatgagcctgacttttcctttcaagatccttggtgactcaggccttggtccctggcagctgaacgtgtttgtgtgcagggtctctgccgtgctcttctacgtcaacatgtacgtcagcattgtgttctttgggctcatcagctttgacagatattataaaattgtaaagcctctttggacttctttcatccagtcagtgagttacagcaaacttctgtcagtgatagtatggatgctcatgctcctccttgctgttccaaatattattctcaccaaccagagtgttagggaggttacacaaataaaatgtatagaactgaaaagtgaactgggacggaagtggcacaaagcatcaaactacatcttcgtggccatcttctggattgtgtttcttttgttaatcgttttctatactgctatcacaaagaaaatctttaagtcccaccttaagtcaagtcggaattccacttcggtcaaaaagaaatctagccgcaacatattcagcatcgtgtttgtgttttttgtctgttttgtaccttaccatattgccagaatcccctacacaaagagtcagaccgaagctcattacagctgccagtcaaaagaaatcttgcggtatatgaaagaattcactctgctactatctgctgcaaatgtatgcttggaccctattatttatttctttctatgccagccgtttagggaaatcttatgtaagaaattgcacattccattaaaagctcagaatgacctagacatttccagaatcaaaagaggaaatacaacacttgaaagcacagatactttgtgagttcctaccctcttccaaagaaagaccacgtgtgcatgttgtcatcttcaattacataacagaaatcaataagatatgtgccctcatcataaatatcatctctagcactgccatccaatttagttcaataaaattcaaatataagtttccatgcttttttgtaacatcaaagaaaacatacccatcagtaatttctctaatactgacctttctattctctattaataaaaaattaatacatacaattattcaattctattatattaaaataagttaaagtttataaccactagtctggtcagttaatgtagaaatttaaatagtaaataaaacacaacataatcaaagacaactcactcaggcatcttctttctctaaataccagaatctagtatgtaattgttttcaacactgtccttaaagactaacttgaaagcaggcacagtttgatgaagggctagagagctgtttgcaataaaaagtcaggtttttttcctgatttgaagaagcaggaaaagctgacacccagacaatcacttaagaaaccccttattgatgtatttcatggcactgcaaaggaagaggaatattaattgtatacttagcaagaaaattttttttttctgatagcactttgaggatattagatacatgctaaatatgttttctacaaagacttacgtcatttaatgagcctggggttctggtgttagaatatttttaagtaggctttactgagagaaactaaatattggcatacgttatcagcaacttcccctgttcaatagtatgggaaaaataagatgactgggaaaaagacacacccacaccgtagaacatatattaatctactggcgaatgggaaaggagaccattttcttagaaagcaaataaacttgatttttttaaatctaaaatttacattaatgagtgcaaaataacacataaaatgaaaattcacacatcacatttttctggaaaacagacggattttacttctggagacatggcatacggttactgacttatgagctaccaaaactaaattctttctctgctattaactggctagaagacattcatctatttttcaaatgttctttcaaaacatttttataagtaatgtttgtatctatttcatgctttactgtctatatactaataaagaaatgttttaatactg

SEQ ID NO: 172497 - DNA, 1780 bp, Homo sapiens
  Payload ID: 13910
  Gene Symbol: P2RY14
  Gene Name: purinergic receptor P2Y, G-protein coupled, 14
  Uniprot ID: Q15391
  ENST ID: ENST00000424796
  CDS Start-End: 383-1399
aagcatatattagagctgggctccaaagaatactggacatctgtagtacctgacattcaagcatttggcgagatgtcaatatttcagagagcactttaaatgttttgatttgaaagctaatgcagtgtttcccactggtcaacacgagcagtccagcagagagcaaaatctatttccctcaacatcaaatgctacactcagttgctgatcctatcttgcctacagagaacctaaaagactggaaaaattggatctttaatgaaaaaacacttgggccacttcaagacgacaaacgctcactgggcaaaacaccttcactgaaaagagacctcatattatgcaaaaaaaatcttaaaaggcctctgccttcagaagttacaagatgatcaattcaacctccacacagcctccagatgaatcctgctctcagaacctcctgatcactcagcagatcattcctgtgctgtactgtatggtcttcattgcaggaatcctactcaatggagtgtcaggatggatattcttttacgtgcccagctctaagagtttcatcatctatctcaagaacattgttattgctgactttgtgatgagcctgacttttcctttcaagatccttggtgactcaggccttggtccctggcagctgaacgtgtttgtgtgcagggtctctgccgtgctcttctacgtcaacatgtacgtcagcattgtgttctttgggctcatcagctttgacagatattataaaattgtaaagcctctttggacttctttcatccagtcagtgagttacagcaaacttctgtcagtgatagtatggatgctcatgctcctccttgctgttccaaatattattctcaccaaccagagtgttagggaggttacacaaataaaatgtatagaactgaaaagtgaactgggacggaagtggcacaaagcatcaaactacatcttcgtggccatcttctggattgtgtttcttttgttaatcgttttctatactgctatcacaaagaaaatctttaagtcccaccttaagtcaagtcggaattccacttcggtcaaaaagaaatctagccgcaacatattcagcatcgtgtttgtgttttttgtctgttttgtaccttaccatattgccagaatcccctacacaaagagtcagaccgaagctcattacagctgccagtcaaaagaaatcttgcggtatatgaaagaattcactctgctactatctgctgcaaatgtatgcttggaccctattatttatttctttctatgccagccgtttagggaaatcttatgtaagaaattgcacattccattaaaagctcagaatgacctagacatttccagaatcaaaagaggaaatacaacacttgaaagcacagatactttgtgagttcctaccctcttccaaagaaagaccacgtgtgcatgttgtcatcttcaattacataacagaaatcaataagatatgtgccctcatcataaatatcatctctagcactgccatccaatttagttcaataaaattcaaatataagtttccatgcttttttgtaacatcaaagaaaacatacccatcagtaatttctctaatactgacctttctattctctattaataaaaaattaatacatacaattattcaattctattatattaaaataagttaaagtttataaccactagtctggtcagttaatgtagaaatttaaatagtaaataaaacacaacataatcaaagacaactcactcaggcatcttctttctctaaata

SEQ ID NO: 172498 - DNA, 554 bp, Homo sapiens
  Payload ID: 13910
  Gene Symbol: P2RY14
  Gene Name: purinergic receptor P2Y, G-protein coupled, 14
  ENST ID: ENST00000494668
  CDS Start-End: 268-554
aacagtgttaccttggagcctacaatgagaggtatttcaaaatgagtgaagcatgactctcacagatgaaggcctagacgcaggaattacctagcaagccatggccaccatccctcttaccctccacaattccaggatctttaatgaaaaaacacttgggccacttcaagacgacaaacgctcactgggcaaaacaccttcactgaaaagagacctcatattatgcaaaaaaaatcttaaaaggcctctgccttcagaagttacaagatgatcaattcaacctccacacagcctccagatgaatcctgctctcagaacctcctgatcactcagcagatcattcctgtgctgtactgtatggtcttcattgcaggaatcctactcaatggagtgtcaggatggatattcttttacgtgcccagctctaagagtttcatcatctatctcaagaacattgttattgctgactttgtgatgagcctgacttttcctttcaagatccttggtgactcaggccttggtccctggcagctgaacgtgtttgtgtgcagggt

SEQ ID NO: 172499 - DNA, 2660 bp, Homo sapiens
  Payload ID: 13911
  Gene Symbol: P2RY2
  Gene Name: purinergic receptor P2Y, G-protein coupled, 2
  Uniprot ID: P41231
  ENST ID: ENST00000311131
  CDS Start-End: 468-1601
gaacagcgcagggaggtgggtagccgggctcccaggcacgtgggtctctgcggctgcggcgggacccgggcactggcacccgggagcggcggcgacggcaccctgagaggagaagcgcagcgcagtggcgagaggagccccttgtggcagcagcactacctgcccagaaaaatgctggaggctgggcgtggccccaggcctggggacctgtttttcctgtttcccgcagagttccctgcagcccggtccaggtccaggcgtgtgcattcatgagtgaggaacccgtgcaggcgctgagcatcctgacctggagagcaggggctggtcaggttccagagcttggaggttccaggtccagatccaagtcagatggcaatgaaagccctggtcaggtggctgtgtcaggtcccctaggggcgctccggccacaaccctgatggccccacccctcccttccctgcagggcgatggcagcagacctgggcccctggaatgacaccatcaatggcacctgggatggggatgagctgggctacaggtgccgcttcaacgaggacttcaagtacgtgctgctgcctgtgtcctacggcgtggtgtgcgtgcctgggctgtgtctgaacgccgtggcgctctacatcttcttgtgccgcctcaagacctggaatgcgtccaccacatatatgttccacctggctgtgtctgatgcactgtatgcggcctccctgccgctgctggtctattactacgcccgcggcgaccactggcccttcagcacggtgctctgcaagctggtgcgcttcctcttctacaccaacctttactgcagcatcctcttcctcacctgcatcagcgtgcaccggtgtctgggcgtcttacgacctctgcgctccctgcgctggggccgggcccgctacgctcgccgggtggccggggccgtgtgggtgttggtgctggcctgccaggcccccgtgctctactttgtcaccaccagcgcgcgcgggggccgcgtaacctgccacgacacctcggcacccgagctcttcagccgcttcgtggcctacagctcagtcatgctgggcctgctcttcgcggtgccctttgccgtcatccttgtctgttacgtgctcatggctcggcgactgctaaagccagcctacgggacctcgggcggcctgcctagggccaagcgcaagtccgtgcgcaccatcgccgtggtgctggctgtcttcgccctctgcttcctgccattccacgtcacccgcaccctctactactccttccgctcgctggacctcagctgccacaccctcaacgccatcaacatggcctacaaggttacccggccgctggccagtgctaacagttgccttgaccccgtgctctacttcctggctgggcagaggctcgtacgctttgcccgagatgccaagccacccactggccccagccctgccaccccggctcgccgcaggctgggcctgcgcagatccgacagaactgacatgcagaggatagaagatgtgttgggcagcagtgaggactctaggcggacagagtccacgccggctggtagcgagaacactaaggacattcggctgtaggagcagaacacttcagcctgtgcaggtttatattgggaagctgtagaggaccaggacttgtgcagacgccacagtctccccagatatggaccatcagtgactcatgctggatgaccccatgctccgtcatttgacaggggctcaggatattcactctgtggtccagagtcaactgttcccataacccctagtcatcgtttgtgtgtataagttgggggaattaagtttcaagaaaggcaagagctcaaggtcaatgacacccctggcctgactcccatgcaagtagctggctgtactgccaaggtacctaggttggagtccagcctaatcaagtcaaatggagaaacaggcccagagaggaaggtggcttaccaagatcacataccagagtctggagctgagctacctggggtgggggccaagtcacaggttggccagaaaaccctggtaagtaatgagggctgagtttgcacagtggtctggaatggactgggtgccacggtggacttagctctgaggagtacccccagcccaagagatgaacatctggggactaatatcatagacccatctggaggctcccatgggctaggagccagtgtgaggctgtaacttatactaaaggttgtgttgcctgctgagctgtgccctattgtgtggtcgggggatgaggatatggcagggaagctttcaccagccacacaagggtcctttctccaatccgttcccttctgccacctgccttctcactagctgtctcaggagtagtctcatatcagggatcctctctccaggccccaggtcatcccccactgtaaagccagttggcttctgtgcctgactctgtgctgagcacagagaaaagtcaggtgcagtcccagtccttgagatttcccagtttaggtgatggccagtcatgtgctggtaaatgttaagccatttaactggagctccgatttaactgggaaccccttctttgtagaactgcccatttccatggtgcaaaaactcttatggccaaattcaaactataaacatgatgtcaacttccttgtaaaa

SEQ ID NO: 172500 - DNA, 2174 bp, Homo sapiens
  Payload ID: 13911
  Gene Symbol: P2RY2
  Gene Name: purinergic receptor P2Y, G-protein coupled, 2
  Uniprot ID: P41231
  ENST ID: ENST00000393596
  CDS Start-End: 400-1533
caaggcgctgggagaggcccggggaagcggcgggccagactggcgcaggtgcggactgggcgcggggcaggggagggcgctgtggagcggctgtcgccccggggcacagttgcgagccggcgtgtagcgcataactggacggcttgaacgcgcctgtgggtccgtggttgaactttgtctccacgggagcgtcggtctcggagccccttgtggcagcagcactacctgcccagaaaaatgctggaggctgggcgtggccccaggcctggggacctgtttttcctgtttcccgcagagttccctgcagcccggtccaggtccaggcgtgtgcattcatgagtgaggaacccgtgcaggcgctgagcatcctgacctggagagcaggggctggtcagggcgatggcagcagacctgggcccctggaatgacaccatcaatggcacctgggatggggatgagctgggctacaggtgccgcttcaacgaggacttcaagtacgtgctgctgcctgtgtcctacggcgtggtgtgcgtgcctgggctgtgtctgaacgccgtggcgctctacatcttcttgtgccgcctcaagacctggaatgcgtccaccacatatatgttccacctggctgtgtctgatgcactgtatgcggcctccctgccgctgctggtctattactacgcccgcggcgaccactggcccttcagcacggtgctctgcaagctggtgcgcttcctcttctacaccaacctttactgcagcatcctcttcctcacctgcatcagcgtgcaccggtgtctgggcgtcttacgacctctgcgctccctgcgctggggccgggcccgctacgctcgccgggtggccggggccgtgtgggtgttggtgctggcctgccaggcccccgtgctctactttgtcaccaccagcgcgcgcgggggccgcgtaacctgccacgacacctcggcacccgagctcttcagccgcttcgtggcctacagctcagtcatgctgggcctgctcttcgcggtgccctttgccgtcatccttgtctgttacgtgctcatggctcggcgactgctaaagccagcctacgggacctcgggcggcctgcctagggccaagcgcaagtccgtgcgcaccatcgccgtggtgctggctgtcttcgccctctgcttcctgccattccacgtcacccgcaccctctactactccttccgctcgctggacctcagctgccacaccctcaacgccatcaacatggcctacaaggttacccggccgctggccagtgctaacagttgccttgaccccgtgctctacttcctggctgggcagaggctcgtacgctttgcccgagatgccaagccacccactggccccagccctgccaccccggctcgccgcaggctgggcctgcgcagatccgacagaactgacatgcagaggatagaagatgtgttgggcagcagtgaggactctaggcggacagagtccacgccggctggtagcgagaacactaaggacattcggctgtaggagcagaacacttcagcctgtgcaggtttatattgggaagctgtagaggaccaggacttgtgcagacgccacagtctccccagatatggaccatcagtgactcatgctggatgaccccatgctccgtcatttgacaggggctcaggatattcactctgtggtccagagtcaactgttcccataacccctagtcatcgtttgtgtgtataagttgggggaattaagtttcaagaaaggcaagagctcaaggtcaatgacacccctggcctgactcccatgcaagtagctggctgtactgccaaggtacctaggttggagtccagcctaatcaagtcaaatggagaaacaggcccagagaggaaggtggcttaccaagatcacataccagagtctggagctgagctacctggggtgggggccaagtcacaggttggccagaaaaccctggtaagtaatgagggctgagtttgcacagtggtctggaatggactgggtgccacggtggacttagctctgaggagtacccccagcccaagagatgaacatctggggactaatatcatagacccatctggaggctcccatgggctaggagccagtgtgaggctgtaacttatactaaaggttgtgttgcctgctga

SEQ ID NO: 172501 - DNA, 2107 bp, Homo sapiens
  Payload ID: 13911
  Gene Symbol: P2RY2
  Gene Name: purinergic receptor P2Y, G-protein coupled, 2
  Uniprot ID: P41231
  ENST ID: ENST00000393597
  CDS Start-End: 335-1468
ggaacagcgcagggaggtgggtagccgggctcccaggcacgtgggtctctgcggctgcggcgggacccgggcactggcacccgggagcggcggcgacggcaccctgagaggagaagcgcagcgcagtggcgagaggagccccttgtggcagcagcactacctgcccagaaaaatgctggaggctgggcgtggccccaggcctggggacctgtttttcctgtttcccgcagagttccctgcagcccggtccaggtccaggcgtgtgcattcatgagtgaggaacccgtgcaggcgctgagcatcctgacctggagagcaggggctggtcagggcgatggcagcagacctgggcccctggaatgacaccatcaatggcacctgggatggggatgagctgggctacaggtgccgcttcaacgaggacttcaagtacgtgctgctgcctgtgtcctacggcgtggtgtgcgtgcctgggctgtgtctgaacgccgtggcgctctacatcttcttgtgccgcctcaagacctggaatgcgtccaccacatatatgttccacctggctgtgtctgatgcactgtatgcggcctccctgccgctgctggtctattactacgcccgcggcgaccactggcccttcagcacggtgctctgcaagctggtgcgcttcctcttctacaccaacctttactgcagcatcctcttcctcacctgcatcagcgtgcaccggtgtctgggcgtcttacgacctctgcgctccctgcgctggggccgggcccgctacgctcgccgggtggccggggccgtgtgggtgttggtgctggcctgccaggcccccgtgctctactttgtcaccaccagcgcgcgcgggggccgcgtaacctgccacgacacctcggcacccgagctcttcagccgcttcgtggcctacagctcagtcatgctgggcctgctcttcgcggtgccctttgccgtcatccttgtctgttacgtgctcatggctcggcgactgctaaagccagcctacgggacctcgggcggcctgcctagggccaagcgcaagtccgtgcgcaccatcgccgtggtgctggctgtcttcgccctctgcttcctgccattccacgtcacccgcaccctctactactccttccgctcgctggacctcagctgccacaccctcaacgccatcaacatggcctacaaggttacccggccgctggccagtgctaacagttgccttgaccccgtgctctacttcctggctgggcagaggctcgtacgctttgcccgagatgccaagccacccactggccccagccctgccaccccggctcgccgcaggctgggcctgcgcagatccgacagaactgacatgcagaggatagaagatgtgttgggcagcagtgaggactctaggcggacagagtccacgccggctggtagcgagaacactaaggacattcggctgtaggagcagaacacttcagcctgtgcaggtttatattgggaagctgtagaggaccaggacttgtgcagacgccacagtctccccagatatggaccatcagtgactcatgctggatgaccccatgctccgtcatttgacaggggctcaggatattcactctgtggtccagagtcaactgttcccataacccctagtcatcgtttgtgtgtataagttgggggaattaagtttcaagaaaggcaagagctcaaggtcaatgacacccctggcctgactcccatgcaagtagctggctgtactgccaaggtacctaggttggagtccagcctaatcaagtcaaatggagaaacaggcccagagaggaaggtggcttaccaagatcacataccagagtctggagctgagctacctggggtgggggccaagtcacaggttggccagaaaaccctggtaagtaatgagggctgagtttgcacagtggtctggaatggactgggtgccacggtggacttagctctgaggagtacccccagcccaagagatgaacatctggggactaatatcatagacccatctggaggctcccatgggctaggagccagtgtgaggctgtaacttatactaaaggttgtgttgcctgct

SEQ ID NO: 172502 - DNA, 4198 bp, Homo sapiens
  Payload ID: 13912
  Gene Symbol: P2RY8
  Gene Name: purinergic receptor P2Y, G-protein coupled, 8
  Uniprot ID: Q86VZ1
  ENST ID: ENST00000381297
  CDS Start-End: 212-1291
ggaagggcagccgtctgccgcccacgaacaccttctcaagcactttgagtgaccacggcttgcaagctggtggctggccccccgagtcccgggctctgaggcacggccgtcgacttaagcgttgcatcctgttacctggagaccctctgagctctcacctgctacttctgccgctgcttctgcacagagcccgggcgaggacccctccaggatgcaggtcccgaacagcaccggcccggacaacgcgacgctgcagatgctgcggaacccggcgatcgcggtggccctgcccgtggtgtactcgctggtggcggcggtcagcatcccgggcaacctcttctctctgtgggtgctgtgccggcgcatggggcccagatccccgtcggtcatcttcatgatcaacctgagcgtcacggacctgatgctggccagcgtgttgcctttccaaatctactaccattgcaaccgccaccactgggtattcggggtgctgctttgcaacgtggtgaccgtggccttttacgcaaacatgtattccagcatcctcaccatgacctgtatcagcgtggagcgcttcctgggggtcctgtacccgctcagctccaagcgctggcgccgccgtcgttacgcggtggccgcgtgtgcagggacctggctgctgctcctgaccgccctgtccccgctggcgcgcaccgatctcacctacccggtgcacgccctgggcatcatcacctgcttcgacgtcctcaagtggacgatgctccccagcgtggccatgtgggccgtgttcctcttcaccatcttcatcctgctgttcctcatcccgttcgtgatcaccgtggcttgttacacggccaccatcctcaagctgttgcgcacggaggaggcgcacggccgggagcagcggaggcgcgcggtgggcctggccgcggtggtcttgctggcctttgtcacctgcttcgcccccaacaacttcgtgctcctggcgcacatcgtgagccgcctgttctacggcaagagctactaccacgtgtacaagctcacgctgtgtctcagctgcctcaacaactgtctggacccgtttgtttattactttgcgtcccgggaattccagctgcgcctgcgggaatatttgggctgccgccgggtgcccagagacaccctggacacgcgccgcgagagcctcttctccgccaggaccacgtccgtgcgctccgaggccggtgcgcaccctgaagggatggagggagccaccaggcccggcctccagaggcaggagagtgtgttctgagtcccgggggcgcagcttggagagccgggggcgcagcttggagatccaggggcgcatggagaggccacggtgccagaggttcagggagaacagctgcgttgctcccaggcactgcagaggcccggtggggaagggtctccaggctttattcctcccaggcactgcagaggcaccggtgaggaagggtctccaggcttcactcagggtagagaaacaagcaaagcccagcagcgcacagggtgcttgttatcctgcagagggtgcctctgcctctctgtgtcaggggacagcttgtgtcaccacgcccggctaatttttgtattttttttagtagagctgggctgtcacccccgagctccttagacactcctcacacctgtccatacccgagggtggatattcaaccagccccaccgcctacccgactcggtttctggatatcctccgtgggcgaactgcgagccccattcccagctcttctccctgctgacatcgtcccttagttgtggttctggccttctccattctcctccaggggttctggtctccgtagcccggtgcacgccgaaatttctgtttatttcactcaggggcactgtggttgctgtggttggaattcttctttcagaggagcgcctggggctcctgcaagtcagctactctccgtgcccacttccccccacacacacaccccaccctgttgctgaccaaggtgatttttggcacatttgttctggcctggcttggtgggaccccacccctattctgcttctgtgagtccctgatagagaaggaggtcccatcaggcccctggaacacactcaggcttccctgactcaggacaaggaccacgggaggcccaggtgcggaaaggaggctccgtgagatggggtccagcccatcccaacacaagggtgcagcttgattcgggagttccccacctcctgcccattctccgcgtccttttaccccatggagagcctcagccatggcaagtccatctggagtccaggaagcaggcaactggcctgacccatgagaccgtttggagaccaagcagcagatgcaggtgtggaccccaggaacctacaggggtgtcagccgctgagccccctccctgctgtgtgggtggtgagcaggctgggtctttgtctgtcttcttctacacggcatgtgcctgcaccagccccaacacctgagctggtttagcgcaaagaagagctctgactctccaggggtgctgggacatcacgtggaattggatcccaggctctcttgggcgagaaagaccattctggaggtgggagtgggagagctgcctgtctgcccacgggctctgcgtctccgcagtgggtggccttggatgcccggcccctccctttctgtgcactggggacgctgatggaggctgaagctgctgttcggaggccctctattggtgcctctctcctgccgtcatcactatggcaggaaaacagagatggtttagtaatgaattatcattcccaaacccgtgtccacctggaacatcaggatgggaccatgtttgaaaatcgggtctttccaaatgtaattaagtaaggcgaggccatactgcatttacaatgggcccaatccagtgtccctatgagagacggaagaggagacacagacacaaagcaggaggccacataaagacagaggcagagactgaagtgatgctgccccaagcccagggatgcctggagtccccaggagctgggagaggcaggaaggaccctcccctagagtctctggagggaactggatacaattgcagagtgcactaaacagttgccccagaaagacatgtcttgttttaaagcccagaacctgaaattattatagattttattcggtaataaggaactttgcatgtgtaattacttaaggatatgaagatgagattgtgctggattattaagcaccctaaatgccatgacaggtgtccttccaagagacagaagaggagacacagacacagagcaggaggacacgtggagacagaggcagactggagtgatgcggccacaagcccagggacacctggagcccccaggagctgggagaggcaggaaggatcctcccctagagcctccagggggaactggaggatgcgtaagagacccagaacttccacagaaggaggaaaattaacctcctgcttctctagactgttccaaagctgaaccctagaaagcaaagctgatacagaagcatccaggctgcaggagtacaggtcgcaagtgctgagcgtgggccttgggtgtgtctcatgggggaaaaaaaactgtgaaaaacctcagagtagcatcttcacagtaacgcacggacgatccctaaactgccttgtaaacaaaaatgagagcttgagtcagaggaagccgagacaatatccttcctcgacaacgtgcgagaaccctgacgtcccccagcaaaggaagacgttgcaagcaggcaaaatgcgtcgattttttttttttgtcagtatgatgatttttgcagccacttggctatggagagcagccgacaccccctcttacagccgtggatgtttcctggaagctgactcagtctgttcactggttgagctttgagtgaaaagataacacaggtctattgactcacacacatgttttaagatggaaaactttacttctgttcttggcaggacatggagagagggagggattccaaaaagtctcagcctccatcaaggcgtggcagctcatgccggtaatctcagcactttgggaggctcaggcgggaggactgattgagtccgggtgttcaagggccaacctaggcaacacagtgagaactcatctctgtaaaaaataaaaataaaacattaaaaaaaaacatgagctttgaagtgcacagggcaaa

SEQ ID NO: 172503 - DNA, 11497 bp, Homo sapiens
  Payload ID: 13913
  Gene Symbol: PURA
  Gene Name: purine-rich element binding protein A
  Uniprot ID: Q00577
  ENST ID: ENST00000331327
  CDS Start-End: 60-1028
cgactgaggcggcgggcggagcggcaggcggcggcggcgcggcagcggagcgcagcatcatggcggaccgagacagcggcagcgagcagggtggtgcggcgctgggttcgggcggctccctggggcaccccggctcgggctcaggctccggcgggggcggtggtggcggcgggggcggcggcggcagtggcggcggcggcggcggggccccaggggggctgcagcacgagacgcaggagctggcctccaagcgggtggacatccagaacaagcgcttctacctggacgtgaagcagaacgccaagggccgcttcctgaagatcgccgaggtgggcgcgggcggcaacaagagccgccttactctctccatgtcagtggccgtggagttccgcgactacctgggcgacttcatcgagcactacgcgcagctgggccccagccagccgccggacctggcccaggcgcaggacgagccgcgccgggcgctcaaaagcgagttcctggtgcgcgagaaccgcaagtactacatggatctcaaggagaaccagcgcggccgcttcctgcgcatccgccagacggtcaaccgggggcctggcctgggctccacgcagggccagaccattgcgctgcccgcgcaggggctcatcgagttccgtgacgctctggccaagctcatcgacgactacggagtggaggaggagccggccgagctgcccgagggcacctccttgactgtggacaacaagcgcttcttcttcgatgtgggctccaacaagtacggcgtgtttatgcgagtgagcgaggtgaagcccacctatcgcaactccatcaccgtgccctacaaggtgtgggccaagttcggacacaccttctgcaagtactcggaggagatgaagaagattcaagagaagcagagggagaagcgggctgcctgtgagcagcttcaccagcagcaacagcagcagcaggaggagaccgccgctgccaccctgctactgcagggtgaggaagaaggggaagaagattgatcaaactgaatgaaacccccacacacacacacatgcatacacacacacacacagccacacacacagaaaatatactgtaaagaaagagagaaaataaaaagttaaaaagttaaaaaaaaaaaaaaacctgttaactccaagggagcaccacccacagaacctccaccaactgacagtttctcttcttgacttgccacccatcgctggatgttgtccactttatccaccatataaaacagtaagcagctgctaaaaacaaaaaaaatacaaaaagtaataacattatatgaactgtgtttcctacttgattaaaaaatataaagaactgagtgtttatttccctaattaaccaagaacttttgtacacgtttaagctattattattaaaaagtgtttgcaaaatggtcaagattataatattgctgaattatataaaagtccttttcatgttgagctaacatttgactttagcacaaaaaagagatattttagaacacgtaaaataatatttttagtttttctcattttgttaccaaatttcaaaccttacatggaggttattatagtatatttgacaccctatatacctgtgattagagatgtgtatatatatgagggctaggcatgctgtgtgtctgagctttgtctaaatgttatgcagaagtttgtagagttaaaggtacgtaggtttaattcatgcaaggtaaacaataagtgctctcttttatacaatatgcattgcatctggaccttaaacttataaaaatggtcagtgaaacttctgtgaacatgaagaaattattaaaaaaggcatttaaatgaaatttgctaagttgtgatttttatggttggaaccaaagttattcaaatagtaaaaggaaaaagaaagaaaaaggagatctcccataatatttttctgcatctgtttgctttgactgagtaggcgttttgtcattattgtgtatatgagatgtacttgtatcgttcataatatattttttttattatgtgtagaaagattttaaaaaactaacgtgcagcaatttccagtgaacctgtacttggacatcaggtagtgagtctatttgtggtcactagcactgtctcctaaacttgtaagaggtctgaagctattctttgatttttgctagtgctattaacttatgtagacctgttaaaaagcagagcaacacaattatagttatcctactgagccatggattctgagttttgttttaaaagtgaaagccaagttggtgtatgtaaaggatttccatgtagctgtggtgctagttattactggctacattatatgctaagtgtatttgtgttccccaagtgtacaagccttctatcaaaagtatgttctataactcatatattcaaggtgtagggtatgaaaatgcaaagtttaggagagcactttaccaagctggtgtcctccaaactgaaattgtttgtaacgatagtcttttacaggttttcctttaaagatgtttgtgtgcttttaattgacaactaacttcttgctgctgtatagtaaaatattaatatatttttatcattaaactgctgcatgactatcatctttgagtgaagagaaaatgttataaaaaagatgccttaaacagtacattttggtttggaattctgtagaaagtattttggtaaaaaaaaaaaaaaaaaaaaagggtcttgtctgacagagagttctggggatggaattgtttcttggcaaatccagccatatagatctaactgctgtatgtataagacaccacctgtaggagcgggaaggtatcagtgcttcttatattgtaaagcattggcctaggaaggcaaacagttgtctttttgaaggatttttttctgctggtcctttgggttttgatttgatatttttatgctccctggttgagtgtgttgtcttcgtttttgagatctactgtatgtgttgaataacaagctattttcattgtactgtgcattttcccattaaattgtttgcttttaatattcaatgttaaatatgaggtgaccgtacagtagttaggagtttctttacttacaaaatcactggaaatgattaaattgcttttccccctccccagaggtgcatttttcttatttccatatagtaaagttgagcttttacagtgcataatgtgacatttggaatgcttatcaactgcatgtaaacattaataacctgcacttttttgtcttaaggtttgttgagctgttttgttcactgtactttaactgtgatatggaaaagactgcattctctgtgctgttactaattaggaaagagaattgctttgattttgtctcttgtttactatagcttcttaaagttaagccttgtactacaggttgttggagtactcctagatcactgtttcatagtagccagcaataagtagtgcaagtcaacaaaaacacagcaaacttaggcaaagtgtcctttctttgagatgcgagttctttcatgaggttttctttagggccagagttacctaaagtgaagcctttcttatctatagacttcagattctgcttggaatcccaccggctcaagaagcacatgtattgtgcaattaattgtctttacactaaaacagtttaatacaatctaactacgattttgaaaccagtgtctgatttatggtcagtgggtttaaaaagaaatccacatgcagatcttttaagacttaaaaagtgatcatagaaaagactaagtgactgtaaagatgctctttttttaagcatctcactttacctccccaagcaccctcccaaaccttgtcttccctcttctgttgcatcctttccctacccttccctcccaggtgctcggtactttacctagtttctatatatcagtgttttatgttggaatttttccttgtttttattttactagttggtaaaccctgtttatgctgaaacaaataaggaaatggtatatttgaccatatgtgttattcatagaagacagtatgatcaaatgtgccaaaaacaagcaaacaaaacttaattcctgagaagtatgccttatttttattgatctgctttgtcttacaattaaggtccaagagcttggttaaactgtattatttgcctaagtataaaagaaaacttgaactgcattgcaatattgacgttctttaaaatgagagacactgtcaagtaatttaatccagagatcagccaccagatttgaaatgcttatgtatgtgtgtgtgtttggagttgtttttttcttttaaatcaccaaattttttttaagctactttttatttgtgcctcctatttatcatgctgatgttagaagcagcagtcatccagccacagagggagctaaagttaactaaccagaactgtagaaatcattatacatgcctttgacaacaaaggaagttcataagaaaagccatgtcggcttttcctctactagatacagattggaggtagatgaatatttgccaaatggaaaaaaagacaatgctagtcagaaaagacaaactgttttccagcttctcaaaaagccatggagagtagaaaccaaaaccaacagggaaataaaaaaccttgaaagtctcactttctagttgtcccatgcaggggttgaaatttgattccaagcggaaagtatattatgttttttcaggccttcacatctagagagatggataacttccaatttgatttttcaggtaatagagaaagctgctagtaattttaacccctgcctaaagaagacatatacttcatttgggagcaaatacttattgccttgaaaagtagcactgtaatagcctatgataattagttgtagaataacctttatccctttcaaactatgcaaattattaaataagtgtaaattaggattcaattaaagatagttgattatattgcaatcagatggcattcacaaacttaactggagcatatacaaatatattagtctaagttttgtatgctaacagaaagatataatttagctacctattctaaaaatggtgaatattattaatattgtataataggagtgggaagactgcctccttttttgaagagagagattaaggatttttataattgtttttcatcaaattttaatatttttgtcaaatttttaggtatttaatttgtaaaacagtttgctttgtactggcatacagaaaatagggtattgattttaaactttttgaagccaagtgatcaagtacatttgtaataaaagtcaatggatctatatcagttgtactcactgttttcatttcttattaatatagggatgctgtactttttcttaaggaaaactgaattaaatttgggtggaagggagggggaaaagataaatccgttgataatgagaatctgggtgggtatcatggcccaagcactttatatcattttttaagtcagttaagatttgatatattttaaaagatactatgtcaacttttttcttcctattttcttatgtaacttgacgtttggggggattatctcattcatttttgtttgtgtgcttttaacattttgtgttttggccctgttcaaactttctaaacacatttttcttttatgacattttgggttatctgctagacctggtgaccccaccatatgggcatgattatttttatcttccacacatggttcaccttcttgtctacaatattcccactcattttttcaggttatatatacacacacatttccagataattttagaatggggctatctgaaattgatggtctagtagctttcatagctccacaattcattttattttacatgtgaacataattttaagattttcttcaccataaaaagtgagataccaagtctaatgacttttttccctttttaaaatcttttgagtatcagaatgagaccttgctatctatgtaaaaggatgctaaaacaagggcatctgtagcaacttaggtttggaatagttggtgatgactctgagtataacatttatagtttattatccctaaatttgaatatcttcataatttggagagagatgtatacacacacatacacatatatatgtatatatacattgtgtgtgtgtatatgtatatagatacacacatctccttgagagtggaataagtaggagagataatttattggaattgcttacatagataaattcaccaaagttatttgtgtagatttgttaaagtgtatcaatttttaaatcacaatatttctgttttcttcattgcatattaaccaaattttggccattcataagtatgctataaaactaaagtgatcactgctattcacgaattattatagaatcttctttgcagattttgtgatatattaagaaaagctgattttaatattaatatttaagaagttatttgatcctgaaaacctaaatttaaggtataggccatttgacacgtcctttttgaacagaaatttcattacaggctaagtgaaaataagccagaattagcatgagtcaggtagaatttcatgataaaagaacaaccagatgaaataagaaataatgattggtttcaagccaatgaatctgctaagctaactaccaagttttgatgttgaatggtccaggcaatttatgtctttaggaaagctgagtgtggcaaaggtcacttgttaacatttttcttaacaagaatgtcataactactcattcatttttattttgtccccacgtttggtatttgttttgttttgtgtttttccttcctgatgtcctttgcttttgtggaagattgtcctgttgataggcagaaacatggtggtgatcctctatgtaaaatatagttgcttcttacacatcagaagtatttcactcattttggaatcacaggattttcatgttttcataaatacacacattgttttgataattattagcaattagcttattttgtagcattagatggaaaaatgtttaagctaaagagtttaattttcttgattttggttccactttaataattcaagaggcctccaagttcaaggaccaagtccttctattttagaattgtgaaaaacatggaaatactcttgttagtgtgtgttttggtctaaggtagattattaacacagaaggatcctaggaggatttaagaaaatatgtccttatcgtgaagtggcagttaaagttatgggacaggtgaattacctattcatcttgactagctcaaacaatgatagccatcagctaatgacttatcagacacatgttgagtttgggtcaaactcccattcagctggagtggattggcaattttaaatgcaggtagttggtggtggtacttgacctacctccttaccatgtacatctggcatcttctctctcctatcctttttctttgtttctctctccacttttactcttgctgtaggcctaccagtggcactcaagcttacttcttcagagagaagtaaagaaatttctgactcctgccttagaacatagctaactgatgatccagaacaatttcagtattatgaggtaactgggcagtttttttctgattgctattttccccatagtcttaagctggcagtttgaaggtatctaaattaatgttaagaaacttgtgaactgaagagagtaagaagtatgtgtattttaggtaagttactgggaactgagacttactggtttggaaattggagagtaggacgaggagagctgtttaatgtgtttgtggatgggggtttgagaggtatatagagaatggtttggaaataaagtgagaggaatttttactagaggtaggaaaaggtactatgatggagtccgaatgagagttatttgctaaggaaatgaagttgatcttcactaaggaagtttcaataaagccagagaaaatgggtccctcattgattatgagaaagctgttagttactatagctagagttatgataatgatcatgcattatacaagtctgttttcatgtataggatgtctgcttttctgggacaaattagcacaattgtggaatgacagcttttctggtcaaggcaagtggatgctggggagttattattttgaggaaaagaaaatttcaagcttttcaccattattctttttaaactatcagaaatatttatcacacatactatctattttcttgggctcttgttacaatgtagtttacctttacttttcaaatggtccttagatcaaattatttgattttgtactccacaaagacacatattattccttgcttttatagaattttgagactttggcccacacaaatttcttagaagacaataaaccaggtaaaaacactaacttgcaattttaggtgtcttttttatttcttttacatttgcatccgtagcaaccatttaaccttgtagaccttatgaggccctcaataatactgtatttctaaaattagacaacataccccccaaactcatgtttctgtttccctactttctctcttactttaaaattgtagtattcccaagagttcagtggtggcaaatgttaataaaataagttagtacattttggaggttcttatatcctttgtagggtaagctgatagtgtttagatttctgttcccattattccagtagtgttttaaattatttaagataaataattactgtaatgtttgtttttaagttacataattcaagtatgtttggattaactctttgttgtcaaatttagtatggatttattcctggtgatttggacagattactttgaagtttcattttactcacatctctatatattagtgataaaaatctcttttaaaaatagcaaaaaagtggttctgattttgtactttgaaggtaatttttcttttttacgaatgtcaggttcattaacaatagcaggattatttttactatagcttattttgtagagttggcactttagtataattttcacattttattgtgtcagattttaaattataatagttatatactataactcatttaagtcaatgcaaagccttcttaaatagcccctcccttagaaatttgtttaaaaagaagtgaattcccaaacctgtgtcaagaacttgtgatttaaatgactgtgagacaagtccttgaaaggcttaagtctagtcagtggagataaatgatagcccatttccatgctgcatatagttgttagggtttataaagttgtcaatgtgtaaaagtgcaaaagcaggaaagactaaagttgcctgtaaaatttctagttttcattatttgcactatttatctttgcacttgattttttgaaagttaaggctagtcactttcacttttgtttctagtcttttctaatttcttgcagaattgtgttttcaatattccacccaaagcaaaaattatatgcaattaaaaatattttataaggccaagaaaatatttcttaatgttagctgtataaaacaaaaatttgttctgataaaatttttaatatgggcctttatttgccaataaaatcctttgtaaatgtgagctttattaaactgtttaaatagacaaagttaaagcttaggatagggaatatatatgtatgtgtatatgaaatgatgtcttcgagttttaacttccagcctgagatggcctagatttggtgtgttagtttgtttcactgaagtcagtgagataggagtctagctgggtacatgcttaaaaagctggaagtgaagtgggtggcaagtggcagctccctctttcatgtagttttccataatgttcatatagtttccttatggtctaagtgttacaactggttttcaagttgttatattgaatattcctttttggaattcagggttgaatcactttgagggggaagggaagcaagggcaagagactttattttaaccagatgcggtcttatgacctcaaagatgtgctctagaaagaaaataacaaaaagtgtacctgtgaacatattttttgtcttggtgatattatgcaacacagtgttcagaattgcaaaaaaatttaaaaattgatagttttatcaatggaacagagagatgtgtttttggctaaaattattttttgtaagttatttggttatttcattttatattccctttcccatagctttgtacacacctcatacttaaaaccaagtgagaggcctcttttcagatctggtttatttttggaatgcctgagtgtgtttccagattggggggggagaggtggtgttttactttttgacatgctcttagcatgttttgctagtcattctggatcttatgtttgcaaattctgttgaacattcagtgatgtatttgaaatgagaaagtcctttataacatagtgtgaatgtttgtggccaattcaattgtggaatcttatggctttgtttttactttgggtagaagtttaacttccattgttcagattttaggtttatctagtgaaattgtgccaggtagttgtctaaatatggaccaattttgggaaatgaagattaataagtgtatatttgattctagataatcctttactcaaaatcataagttaaagattcacatcattaagagttatctaacttttatgttgtcaaatctttaaatgtggatgatattcagcattctatctatgaatttcctttaggaaaagagaaaaattcagtctccaaaccttttcttggagacaaaatttaccacatatcgaaaatgaaaaaaatttagaaagcgatttgattattttttaatggagtttaaccagcttaattaatgatttttccagtttgaagcacttattttcccaatgtgaataaagggaaaagatcagcaatttgtccctggcctttttcgaggccatttttagttttctgcccccatttcccagtcctggtataaaatgaattacgggtatccctctaagtccctataaccctttttgggggtcacagatatctttgataatctgatgacagtgtgatggatcctctacccaagaaaaaaaaaatgcccatccctggataattttgcatacaacttcaggggcatcacacatcttctgaaacccaagttaaagatctctgctctaagtaaattgtagagaattttagtgcaaatcgttgataaaattaggaaccaactattggcttaaaacctttcatattggaattattgttagatggtggcccctactagcaaaatgtgacattgcaaccagcttcgttagacattataacaaccagagagaagggaaaaaagcaaagttctgaaagctatttataaggagtcagggcatctctagacatgggagccttcctggttcaaggcaggggtcagggtgcctgacaatttctagcagggtagagtttgataaaccacaatgctcaggatgccaaggggttagccattatcttaaccccttcctcaccaaaagattttagttttgtctgttgggaaacaagatgtcactagggaaaaaaa

SEQ ID NO: 172504 - DNA, 9069 bp, Homo sapiens
  Payload ID: 13914
  Gene Symbol: PURB
  Gene Name: purine-rich element binding protein B
  Uniprot ID: Q96QR8
  ENST ID: ENST00000395699
  CDS Start-End: 14-952
ggcggcctagaagatggcggacggcgacagcggcagcgagcgcggcggcggcggtgggccgtgcgggttccagcccgcgtcccgcggcggcggcgagcaagagacgcaggagctggcctcgaagcggctggacatccagaacaagcgcttctacttagatgtgaagcagaacgccaagggccgcttcctcaagatcgccgaggtgggcgcgggcggttccaagagccgcctcacgctgtccatggcggtggccgccgagttccgcgactcgctgggcgacttcatagaacactacgcgcagctgggccctagcagccccgagcagctggcggctggcgccgaggagggcggcgggccgcggcgcgcgctcaagagcgaattcttggtgcgtgagaaccgcaagtactacctggacctcaaggagaaccagcgcggccgcttcctgcgcatccgccaaacggtcaaccgcggcggtggcggcttcggcgcgggccccgggccgggcggcttgcagagcggccagaccatcgcgctgcctgcgcagggcctcatcgagttccgcgacgcgctggcgaagctcatagacgactacggaggcgaggacgacgagctggcaggcggcccgggaggcggcgccgggggcccagggggcggcctgtatggagagctcccggagggcacctccatcaccgtggactccaagcgcttcttcttcgatgtgggctgcaacaaatacggggtgtttctgcgagtgagcgaggtgaagccgtcctaccgcaatgccatcaccgtacccttcaaagcctggggcaagttcggaggcgccttttgccggtatgcggatgagatgaaagaaatccaggaacgacagagggataagctttatgagcgacgtggtgggggcagcggcggcggcgaagagtcagagggtgaggaggtggatgaggattgaaacgggcagcttcccctacaggcctccacccaaccaccatccccttggctagagaattccctttcctgctcatccccagtgagctagtggagagggagcaagggaggccgcagagggaaaaaacaaaacgtaacacagttaagagaaataatcgtaagagaacagtgacggacaacttgagaaaagcagtcaagttccaaggaactgacagcaacctgcaaagaggaaaacagcatctcctcacctgcgtaaaattgtctcagcttctgttgtttctcaactgaggttcgtaaacccatcaggataatccctggagggaatagatccttgcacatccagggcaagaaacatgtccaagttacccagaccattgataacagttgcatttaggttgcacctgggtaatctggcataaaagatctctctaggcctcactgttgcggtgtctatcccttcacctccattgaaatcagcattttggatctaggtcttcatggaatccttgagaagagaggcctttacaattacccagttctgagggttcaggttcacgaaaagaaatgcaacttgggataatcatgaacaggttaaagataagatttcaagaagccatctaagaatacagaaccaaattggatccatttttttaaaaaaatggttttgcatggaacctggaccaaggcaaatgtcttttcttcgcagaattgttttccaggatgccagtggattcagatagcaatgcttggagtagaatccgttactaaaatagtttcaaagttgacaaaaaattttcaaagataaaagcagttttacattgggggttgctgaggtaggcacaagaaaaagtcaggcataaagcacaaggcagactgtttgagtggattggttgctgctcactaaagttgttcccctgatctctaaatatggaggtcattaccaagaaatgctttggtatgaatgagagccagatctccactgtgtgagccagtgaattatggctaattcggctgttacagccactggttggctggattttaaaccataaaacttgaagattacctacaaaagtaacagtgtggctataagcctgagctttaatggatatacatcctcacagaaaagttggaaataaccaaaactgaagtcttaatttaccttcagtttaatctgtggatttgttcaaatactaaagatcctcaggtccagaattccagcatcatttattcttttaaaatttttaagaacttgatccattgtatcagtacctcacaatcagagttggcaaatgatggatgagtgattcaagcagtgcacccggtggaagctgaaatccatctgtgaatggaactgaagtgaacgtgaatatgctgactatatcctggaagcatttttataccatcttgaaatttcaacaaactggcttttgccagttaatccagctgtctttcaagaataaaagttggggttttcaaggatcgcctcttctatattttaaatggattttcagtagaaatgatttttactaatcaagttaatcccaccccatcaaaaggtattcctagaaatgtcatagacctaggtaactttgaattgaatgggagctaacgttctttccaaagttttcaggtattctttgtgtgacaccttctcaaccaggaggcaagtaaccccgcctccacaatcttagtattttttttaaactgcatgcctgccccttatttgagctgcctttttaatttattgcatatcctttttattatcttattttggtattattcaatctatacaatctttttgtatttattgggaaatgagtaatatacaaaaaggttttcatgtatttgtggctgagagggcgggaaataattgtgtacataaaattaggcttttttaaaaaaatagattatgatgcagaatattgttgatcttagattaaaaagtggaagagccacaaacattggtgcccttttcagactatttctctactctcatcatccacagtagaatttttaaacagatttttttaaagcttttcttttaaatttttctccgttgcaaagaatgtttcctaaattgtatgggagcaatagtatttttgatgttttaatgacatccgtatacttgtactgtattttgtactacaaggcagctgtttttcaataatgtcctgctgtatttacctacgtgttttgagtgtctatttctttgctgcggagaacaaattcctaaatagttttagtaaaggagctgagaagctagcattaggtttgcagaaactatttaagtttcaactctgaggcagcaatgaaaatttaagttgcagctattagttgattgctgtaactttttcattttcaaaccatgtacaattcttgtatagaccaacttgttttcttgcttcagtggtggttctgttgctcagctgcagtgagccagttcaattttgcaaaggtgcagtacctctcctttttaaggggttggtttattcttttttctttttgtttggctgaattgcagtaactagccttgcctttctattctgtagaaatgacagggtcttcacaatccttcaccagtggctactaagctataattagctgaatagaaagaatgtggaagtggtctgaggcatatagagtatatgccaagaacactaccatatatggcatcagctttggttaccagagaaattttcttagtcattagaccatgtaacagtaatatatcatatgtaaatctttagatatcaatttgaaaatcctccaaaaaaaggagcaaagaatgcataagctatgtgttggcaaaagtaatttatattaaaattttgacctgcctatgtaagattaagtggtaatgtcatagtggtgggtttttaagtcttaaccaatctctaaggtttgtttctcctgcaagggatggttcatggcctctcttcccactgcaggaagattgcagaaggctgtggattaattgtagcatttcactgatcttcactccagtcactagggacaatagaaacctgcaaaacacagattcattcgtaaatattattaatagcttattaaaggaaatggtctttgttaattccagtcagataatggcattgtacagacatgggaaacaaccaatttttttgtttttcagttgttgctatgaatgattttgagcctttttttttaagcttggcaaacatcccagctaatcaaaatagtcatattcctgagaagtaggaaactaaaacttcttttcatataattgttagaaggtttgtttcccaaactaccatagttacaaaggtgaaaagccaaattttaggaacagaatcaaaagaataaaaatctgtgaagagatcctactactcttccttctatgttttggttttggtttctattgtccctatcatttcagcaagtggaacagcagcaagtttttcagtgcatatgctgcacaagaacaaaatataaatctgtatggcaccaaaaatcaaagtgaaaaccaaaccaaaaacccaaacaccctatgtaactatcggaggcatatacgtggtataaatgactgtagctgtgatacacacatggctacttgtcacatcactttccataattatttactgcaaaatgattgagaggcttttggtgcaggcagccgttaacctcctgcttcctttgttacctctggattactttgcagtaaattgcaggtcttttaagagatttaagcttcagttttctcaaaacaaaacaattatcctgtcttatctgaagatgcagggttgtgggcaaaagaggctggttataataatgccctcatattgagtggtctgtaaacggctgcacacttcaggcactgtagttgctgaagatgctttgttaaatgtgaccttgactggctttacaggggtgtagaatgtaatctacacaaggtgactttgcatctatcttgctcttgaggtggatgaaattgagaagctggagtgtgtaagccatgcacataagtattcttcactgtaaattttgttttcatttttaacccaattatggtactttatccaatgcacaactgatctctcagtagatattcatttgaaaatagtgtggccttgatcagtgagaaagggaaggagaaaagtgacttttttgcttatgtagaaatgactcatttgctgagagtttgtctttctgcagcactcttggtatatagtgatcggtctcctttttgattggggaaagttaatgtttttgaccctggagttaattcagttgagttatcttatatttttaggaagtatcagaattgctctgatgaataacaaagttgactgttttgatgtccaatctcaggttttagaatatagtggtgtaaagtcccactatttttaattcttaaaacaactttaatttcgtacaccctaaaagtcacatgcataaggcctgttcagagagcagagcctccatctttttgctccttttctactttgtacttcacttgaaaaaatatcaagtgactttacattgtatatttccattgtaaccctgacatttctcaaagataaagcactttttgatcatgaaatacatgaaatctttgtgtgatgtggatcatagtttctcaggctcccttagataattgcttatgaatattgttctaactctgtgtaagaagagtagaaatctttgctaatgttagaaggtttgtattattgatccagaatgcattttgctagtttccaatggatgggagagtaaataatgctgcattcacaatttaataagttactttcccttgagccttaaggtaactttttctttcctgtcaactacagcactgaagttatagtaagtgaatgagattatcagttttcagggttggttttagagtactgtaaatcaattagctgtcttcctaaagagttacaactcccattcagtatactggataatgggtgtgtgggtggggctggggagggcgggagatagtttgtagaaaagaaaaaagaaaaaaaaaaaaacacatttaccttaagaaaatacagacaaaaaagaataaagtatgtgtcatatgctccatttgagattccaaatgcggccgggcgtggtggctcacgcctgtaatcccagcactctgggaggctgaggtgggcgggtcagttcaggtcagcctggacaacatggtgaaaccccgtctctactaaaaatactaaaattagccgggcatggtggtgcatgcctgtagtcccagctacttgggaggctgaggcaggagaatggcatgaacccaggaagcggaggttgcagtgagccaagatcgcgccattgcactccagcctgggtaacagaacaagactccgtctcaaaaaataaataaataaattccaaatgtaaggtggaaatggcagattataacttcatttcccccatttttaacttagaaaaaacaaagtccttaattttcaagtattagccccccagaagtttcagcagatagctggactcttgaataatgatttcttttgatatgtctgactttgctatttaaagtctcctttcccagccctcagtcttaaaactcagttttattactgacggatttaacagactcttacttgaaaattgtccaattatcagtactgaaaattagatttggaaaatgaaaaaataataaaatcgcatcaagaaaacttattaccttagagattcccaattgatatctgtacccctgatccaagtaaggcctttatgaatgtattttatatttcctaaagaaatagggaatatgccatcagtgtaatcacctctattcacagtcatttaatttgaaaatctaactcatgtctcttgaattagacattccaattgggataggtagagtcatgttaaaacaatagaatagcaactgccatattggtagtttcactgctcaatatgatttctaataagagcagagctttattggaagctaaaactcatttttctccatagatgattctaacagtttaataaaaaagtataattatactttaagtgtcaacagattttgagtctagaagcaaatttcattttccttgtgttatatctaatatccattgacatgggtaagaaaactaattatgtctttttagtatgatgaaatgtgggcccagagtattggaaagaaagcaatagccctattcagtgtccactaggatggatattgcagaaggcatgagtttgtccttttttcccccttaccttaaataacacttcaatagctaactttttccaaaatatccatttaggccatctcttatttcttaaagccaaatatttcgtccccagtcttaactctgagttgcaagatcaggctggttggaagaatctttatatttagaaataggatggtgagtggtttgtttattctcttgtaaaattcctttttcagagacataactgcagggagagtcccaagagaactgaagaactggattatatcattaaacacatttgtgttgtaggaatttgggagtttcattttgaactgataagatattagacataaacccttgttccagcccacatgtgtcatccctgtgtacaaaagctctctggattctttttttttttttgagacggagtttcgctcttatcgtccaggctggagtgagtgtagtggcttgatctcagctcactgcaacctttgcctcccgggctcaagcgattctcctgcctcagcctcccaagtagctgggattacaagcatgtgccaccatgcccagctaattttctgtatttttagtagagacggggtttcaccatgttggccaggctggtctcgaactcctgacctcaagtgatctgcccgcctcagcttcccaaaatgctggaattacaggcatgagccatcacgcctagcctactctctgaatttctaaaagtcagtaggttgaccaaaaagtctagaaactggctttaagtcagtatgggacgtacttataaagagtccatggttttgcacgtttcggtagacaagtaaatctgagttatttttcaatgacttaccaatatttgaatagtaactaagatcgtcagtgtatctggacttctttttttgaagttctaaaacaattatagtagggatttattattttgggcctccatccagatgtttttccaagatcatttttaaaattcatttgtcttctgtttccagataacatactttccgttctataggaatcttcactgccaatcatagtatctaccagtggctttcttagactattcactccaaagctgggactgatgtcctgccagtagagaatctacagaaataatttgaatgaattaaaaccaaatcttgatagcaggagacagcttcctgatctagatgtacaattagagtttaggttggaaattactttaaaatgtgttttttggggatgtcttcaatctctgtgtaaatacccacatgcttatgcattgtaaaccaagtgtgtattcctgtgtatgaatttgtagaactgatttctgcttcaagagaagctgcacctttaattttataaggtcccctccacctgtaaccctataaatgtctgtaaataaaacactaaaatttgtagtgataggatcaatttgggaatatctgctgagagaccaaaaagttcatttttttaagtaccttggttaaagagtaaagattattcctcttattttttaaagaagaatgcactttaacaaacatagagctgcatgggcaattcaaacaaatctgtgaagtgcagtacccattcagaaatcacacttcctgaaaaccgttcaaaagcagagtccagacgggctgttgatctcactgcctgtaggttgaagctcagattctgatcaattttgagaggagcagggctgcttcaaaagagcaatgtgaatacagtcagaagcttcagactggtctgtaaaaatggcgggtcccgtatttaccactaactagcaaaactgacagaaaaactcacagagaaaaaatgtaagaatccttcctgctggtgtgcactccttacaatagacttttgcaaatggagttttacagtctatatttaaaaaaaattgtatgtttgtaacaaataaagtatgcagaaaagtgaatgacaa

SEQ ID NO: 172505 - DNA, 2693 bp, Homo sapiens
  Payload ID: 13915
  Gene Symbol: PURG
  Gene Name: purine-rich element binding protein G
  Uniprot ID: Q9UJV8
  ENST ID: ENST00000339382
  CDS Start-End: 934-1902
ctttctcgcggcgctgcaaccctcccaccacagcccatccagccccgcccagcgcgccgcggtgcgcatgcgtggaggccctcgctgccgctgagcacctcgggaagtgtagtctcttcgcaggtgcggctgggcagctagagtcctgcatcccggtggaatccggagaagtgagaacattcccgccgcccggtcctcattcccatcttcccacctgtccagtcccctcgcactcccgctgcaccccacgcgccgggcttcagtcagagagtgcactgaggaagagcggagaccccctcttcccctcagcaggctgtgccgggggaggcggggtccaccgcccgccccccgccgtcgctctccccgcctccccttccctcccctcctggcgggtgcggggccggtgtccgaagtcaggcggcggcccccgcagcggccgcaggaggggcggctgcggtgggcgccgcgggcgatgcccctgcccggctgctccggcggggggcagtgcgagcggcggcggcgggggaggaggcggggggcggcggctgcggcggctgcagcagaggggccgagagctggcggtggcggcggcggtggtcgtgaagggcatcggcggcggcggtgatggcagagatgatgtgagtgcccgccggctggagacctggggccgcggagcgcgggacgggcggcggcggcgtgcgggagcggccccgggggcggcggagggatgcggggagcgcgggcagagccggagcggcggccgccaaccggccggcagtggctggagccccgcgctgcggcgccgggggagccgggcccggcgtgggggtcgcgggcggcggcggggcggtcaggccgaggggcgtctgcgattgttctcaacacccctcccccaccccatcccgtgtgtctgtttgttacttgcagctgaagatggaaagagccaggcgaaggggaggcggcggcggccgcggccgcggaggcaagaatgtagggggctctggcctaagcaagagtagactctatccccaggcccagcactcccactacccccactacgcggcctcagccacccctaatcaggccgggggcgcagccgaaatccaggagctggcctccaaacgagtggacatccagaaaaagaggttttacctagacgtgaagcaaagctcccggggccgcttcctaaagatagccgaagtctggatagggagaggccggcaggacaacatcagaaagagtaaactgaccctctccctgtctgtggcagcggagctgaaggactgtctaggggacttcatcgagcactatgcccacctgggcctgaaaggccaccggcaagagcatggccacagcaaagagcaaggctccagaaggaggcagaagcactcggcaccctccccaccagtctcggtggggtccgaagagcatcctcacagtgtcctgaaaacagactatatcgagagggacaataggaaatattacctagacctaaaggaaaatcagcggggtcgcttcctacggattagacaaaccatgatgcgggggactggcatgataggttattttggccacagtttgggccaagaacagactattgtcctcccagcacaaggaatgattgagtttcgtgatgccttggttcagctgattgaagactatggcgaaggagacatagaagaacgaagaggtggagacgatgacccgcttgaactcccagaggggacttctttcagagtggacaataaaaggttctactttgatgtgggctctaataaatatggaattttcctgaagctcacaaattaccccaaatccagagagaatatcaacctttttcactgttgtcaaatcaagcataaggaacagccccatgatactacaaaaacagttgaggaataaggaataaatctcttatgttacacctcagaataaaggcattcggtgaaagaaatgaactgaagttcatcatgaatgtaaggcctcagtacttgacattcctccacggaagggaagacaagtatcaacaccactggcatcatttccaaactgatcttatgttgaataatttccaccacattgaagtacctttcgactctatccagtttttgggttttgttttttttaattcatcaagcctttcgttttcaaaccaccatttgtcagccttgaggtagagagacatatagatttgaaaatactttcttaagagatcatgtaactatataactctgaatttaaaaattgaggggggagggataatttcaacccactgcctcttaccagaaacatttttttaaatctgtaactgctttagtgttaacagggtgcaaggtggtttttgtcccgtattgttcttaaaaggttctcatttattgtgattgtattgtactgtatgagaacaaatcataaattgccttgtattgtttataatagaccataccacgtactacttcagtttttatgttccaagtttttcagtgatgcatgttaacagttaggtcctaaaattctgtggtgctaattctcccatacccaatggtgcttttgtggatgctaactgcacacatgctgaacaaagcttgaagtttaaaactttcctcccttcctctgtttatatgaagtaaaatgaaataacttgaatttgtctcaaagtatcactgacaatctaataaacttgtttatatgtgtga

SEQ ID NO: 172506 - DNA, 2875 bp, Homo sapiens
  Payload ID: 13915
  Gene Symbol: PURG
  Gene Name: purine-rich element binding protein G
  Uniprot ID: Q9UJV8
  ENST ID: ENST00000475541
  CDS Start-End: 934-1977
ctttctcgcggcgctgcaaccctcccaccacagcccatccagccccgcccagcgcgccgcggtgcgcatgcgtggaggccctcgctgccgctgagcacctcgggaagtgtagtctcttcgcaggtgcggctgggcagctagagtcctgcatcccggtggaatccggagaagtgagaacattcccgccgcccggtcctcattcccatcttcccacctgtccagtcccctcgcactcccgctgcaccccacgcgccgggcttcagtcagagagtgcactgaggaagagcggagaccccctcttcccctcagcaggctgtgccgggggaggcggggtccaccgcccgccccccgccgtcgctctccccgcctccccttccctcccctcctggcgggtgcggggccggtgtccgaagtcaggcggcggcccccgcagcggccgcaggaggggcggctgcggtgggcgccgcgggcgatgcccctgcccggctgctccggcggggggcagtgcgagcggcggcggcgggggaggaggcggggggcggcggctgcggcggctgcagcagaggggccgagagctggcggtggcggcggcggtggtcgtgaagggcatcggcggcggcggtgatggcagagatgatgtgagtgcccgccggctggagacctggggccgcggagcgcgggacgggcggcggcggcgtgcgggagcggccccgggggcggcggagggatgcggggagcgcgggcagagccggagcggcggccgccaaccggccggcagtggctggagccccgcgctgcggcgccgggggagccgggcccggcgtgggggtcgcgggcggcggcggggcggtcaggccgaggggcgtctgcgattgttctcaacacccctcccccaccccatcccgtgtgtctgtttgttacttgcagctgaagatggaaagagccaggcgaaggggaggcggcggcggccgcggccgcggaggcaagaatgtagggggctctggcctaagcaagagtagactctatccccaggcccagcactcccactacccccactacgcggcctcagccacccctaatcaggccgggggcgcagccgaaatccaggagctggcctccaaacgagtggacatccagaaaaagaggttttacctagacgtgaagcaaagctcccggggccgcttcctaaagatagccgaagtctggatagggagaggccggcaggacaacatcagaaagagtaaactgaccctctccctgtctgtggcagcggagctgaaggactgtctaggggacttcatcgagcactatgcccacctgggcctgaaaggccaccggcaagagcatggccacagcaaagagcaaggctccagaaggaggcagaagcactcggcaccctccccaccagtctcggtggggtccgaagagcatcctcacagtgtcctgaaaacagactatatcgagagggacaataggaaatattacctagacctaaaggaaaatcagcggggtcgcttcctacggattagacaaaccatgatgcgggggactggcatgataggttattttggccacagtttgggccaagaacagactattgtcctcccagcacaaggaatgattgagtttcgtgatgccttggttcagctgattgaagactatggcgaaggagacatagaagaacgaagaggtggagacgatgacccgcttgaactcccagaggggacttctttcagagtggacaataaaaggttctactttgatgtgggctctaataaatatggaattttcctgaaggtaagtgaggtgagaccaccttaccgtaatactattactgttccattcaaagcttggacaaggtttggggagaattttatcaagtatgaagaagagatgaggaaaatttgcaacagccataaagaaaagagaatggatggcagaaaggccagtggtgaagaacaagaatgcctcgactagagtgaaattgaactccatcaggcaaaatttaaaatcacaaattggctaaaagtactgatccattatcctttgaagaagtttttcctcttttttggcccgttgttattagtaatacctctagtagttgatacttcaggaagtctgattctcatgttatgttacacatagatcactataattcttacgggaattccaaccttcccagagctaaatagtttagctgcttcaactgctccagactattgaagtatgcaaatcagcacaaaatgtgacattctgacattctaaataccataactaagatttacattgcactatgacataatcccgaaaaaagatacatatacttaaatagaagtgtgactttcccccaaaagtatttcaattctacttcattaaaagctgctaagcttacctgtagggcagttaccacagaaacagaaattgacctccggtatatataaatatttacttataaaagtacaagtagacgtatattgtccgttgaataactgaatataccatcaaaggatcaaatcttattacctaattaaaccttaaaaatataatgtcataatatttcttaagaatactatagtattctataatttcaaactttgtggtaaccctacattttatagttgccatatcaaagccatgggagagttttaattcgttattctaagtttagttacaatcccttctttacctctacttaatgttccatatatttttattgactttccaaagtttcaggaattacttttatgtcacattgagtgggaggcttcatccaatggctttgctatggaaatcttggtggtgtagcttttcatgctaatttaaagattgcaagaggtttcttccccaaaatatatcatggactcaaggtgttata

SEQ ID NO: 172507 - DNA, 614 bp, Homo sapiens
  Payload ID: 13915
  Gene Symbol: PURG
  Gene Name: purine-rich element binding protein G
  ENST ID: ENST00000523392
  CDS Start-End: 124-614
gggggaggaggcggggggcggcggctgcggcggctgcagcagaggggccgagagctggcggtggcggcggcggtggtcgtgaagggcatcggcggcggcggtgatggcagagatgatctgaagatggaaagagccaggcgaaggggaggcggcggcggccgcggccgcggaggcaagaatgtagggggctctggcctaagcaagagtagactctatccccaggcccagcactcccactacccccactacgcggcctcagccacccctaatcaggccgggggcgcagccgaaatccaggagctggcctccaaacgagtggacatccagaaaaagaggttttacctagacgtgaagcaaagctcccggggccgcttcctaaagatagccgaagtctggatagggagaggccggcaggacaacatcagaaagagtaaactgaccctctccctgtctgtggcagcggagctgaaggactgtctaggggacttcatcgagcactatgcccacctgggcctgaaaggccaccggcaagagcatggccacagcaaagagcaaggctccagaaggaggcagaagcactcggcaccctccccaccagtctcggtggggtccga

SEQ ID NO: 172508 - DNA, 776 bp, Homo sapiens
  Payload ID: 13916
  Gene Symbol: PCP2
  Gene Name: Purkinje cell protein 2
  Uniprot ID: Q8IVA1
  ENST ID: ENST00000311069
  CDS Start-End: 292-702
gacatcacacctgagagtccctggggtccagtcattgctgctgggcacagcgaggtccaagctcaggtcgccctgccccctacccaccatgccagatccagcatcgttgtgggcaaacaattatctggatgatctttatggggcttaagcttgggtgggagcagatggggcatgagctggggatttggggatggggggaatccacacccccacgtcctggacgtttaaaaggccctctctggcactgggccggggcagaggccagcagaaaagtgactggagtccagggacatgatggatcaggaggagaagacggaggaaggctcaggcccctgtgccgaggcgggctccccagaccaggagggcttcttcaatctgctgagccacgtgcagggcgaccggatggagggacagcgctgttcactgcaagccgggccgggccagaccaccaagagccagagcgaccccacccccgagatggacagcctcatggacatgctggccagtacccagggccgccgcatggatgaccaacgtgtgacagtcagcagcctgcccggcttccagcccgtggggtccaaggacggagcacagaaacgagctgggaccctcagtccccaacccctgctcacccctcaggacccgaccgctctcggcttccgtcggaacagcagcccccagcccccgacacaagccccctgagggcctgaggcatcctgggtctcactcggcccccaaaaactgataaaagaataaaacacttaaatgaataacaa

SEQ ID NO: 172509 - DNA, 457 bp, Homo sapiens
  Payload ID: 13916
  Gene Symbol: PCP2
  Gene Name: Purkinje cell protein 2
  Uniprot ID: Q8IVA1
  ENST ID: ENST00000598935
  CDS Start-End: 17-379
aggatcggcggggaccatggcgggctccccagaccaggagggcttcttcaatctgctgagccacgtgcagggcgaccggatggagggacagcgctgttcactgcaagccgggccgggccagaccaccaagagccagagcgaccccacccccgagatggacagcctcatggacatgctggccagtacccagggccgccgcatggatgaccaacgtgtgacagtcagcagcctgcccggcttccagcccgtggggtccaaggacggagcacagaaacgagctgggaccctcagtccccaacccctgctcacccctcaggacccgaccgctctcggcttccgtcggaacagcagcccccagcccccgacacaagccccctgagggcctgaggcatcctgggtctcactcggcccccaaaaactgataaaagaataaaacacttaaatgaataacaaggaa

SEQ ID NO: 172510 - DNA, 660 bp, Homo sapiens
  Payload ID: 13917
  Gene Symbol: PCP4
  Gene Name: Purkinje cell protein 4
  Uniprot ID: P48539
  ENST ID: ENST00000328619
  CDS Start-End: 186-374
gcccctggtgctctcagatgtcggccaggcttgcagacaggtgaatgcatctcattggctccagggaggcatgatgccaccgggcagctctttttaagagaaaagccagaaccggtggagcagcgacccctgagcagtgttctctgtgctgagcggcgggactgagctgttgagttagagccaacatgagtgagcgacaaggtgctggggcaaccaatggaaaagacaagacatctggtgaaaatgatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgaattcaa

SEQ ID NO: 172511 - DNA, 683 bp, Homo sapiens
  Payload ID: 13917
  Gene Symbol: PCP4
  Gene Name: Purkinje cell protein 4
  ENST ID: ENST00000462224
  CDS Start-End: 64-159
gcgacccctgagcagtgttctctgtgctgagcggcgggactgagctgttgagttagagccaacatgagtgagcgacaaggtgctggggcaaccaatggaaaagacaagacatctggtgaaaatgtcgggtgccccattctcttccttacacactcctgactggctcagcggaaggagctcctgccactcctctaacagcatctgaccttccccgccgccccgggaactggactctctgaagtatacagaaaagtagcgattccttaaatatggacagaagaaagttcaagaagaatttgacattgacatggatgcaccagagacagaacgtgcagcggtggccattcagtctcagttcagaaaattccagaagaagaaggctgggtctcagtcctagtgggagaaccccctcctagtccacctgaaaacaccaaattcaaccatcatctgtcaagaaattaaaagaacaacaccctagagagaagtcatccacacacaatccacacacgcatagcaaacctccaatgcatgtacagaaacctgtgatatttatacccttgtaggaaggtatagacaatggaattgtgagtagcttaatctctatgtttctctccattttcattcctcctgcaactattttccttgatgttgtaataaaatgaagttacgatgagtgaattcaa

SEQ ID NO: 172512 - DNA, 1424 bp, Homo sapiens
  Payload ID: 13918
  Gene Symbol: PCP4L1
  Gene Name: Purkinje cell protein 4 like 1
  Uniprot ID: A6NKN8
  ENST ID: ENST00000504449
  CDS Start-End: 249-455
ggccggaggcggcgagctgagcggctctgacaggacgggtcgcagggggtcgcctggccggagctgggctccgagaatcccgggtgccagcaccagagcagcggctctccgcactaactctcctctcctggtcagctgtaacccctgccgcagagcccggcaactttcagctgtcgcccgcggagccccgagggccactcgcctcacctgtgcgtgcagcgcctcgcgcgccctgtccggctgcggagatgagcgagcttaataccaaaacatccccagcaaccaaccaggcagctggccaagaggaaaaaggaaaagctggcaatgtcaagaaggcggaggaggaggaggagattgacattgatctgacagcaccagaaacagagaaggctgcccttgctattcagggcaagttccggcgatttcagaaaaggaaaaaggatcccagctcctgaatggccaggcttgcccttcaccttcaccttcatgctggtcccttctctccccttctccacacccatgtatctttatcccttgtccctctagcctttccttgaggcaagttcaacctttatatactcttgtatctggccccctcaagccatcacagaagtagaggcacaagagaggtggagaagatgaagacttcaatcagcagtcactagtctaagggtggaacaatttcttcttggtataaggttctttgatcagtagctatgcctgccctgtagggctaaacaagaggcttcgaggctgagagatctccccaaagaacaatgtgggaaggaggggaaggctttcagagtagggtgcctgagggtgggacatatgcactgttctgctagttacggcattcacactttaggtaacattttttttccccttcagatccttctgcaccaactccaacttcccctcccaggatctaagccacagtggggactggagcctcgttttccccctaggcagacctaaatcaagcagcttaccacaatagtgcatgctgagtagattagttccaaggaagggagactggaatgctggtgtcaaggaaaagcctccctcatcatctagtctaagaccataacgggcagaagcataagaggttccagggccataggagaatgagaagtagggcacatatagggaggaaagaaaagtgaagaagggggaaatctctgaatttttttactgctgggaaaagtgtactacatgaaggatgcttggggctttgctaacctgctcaccgctaaccctccaagtctaaccatccccagaggccacacaaaccaagtgactcctgtagttcccatttgccccactatggagtcagggcaaaagtggaatagccactccatgtgattttagcatgtttaatcattttaacaataaaccaccccacaaatggggtcatttaacctcta

SEQ ID NO: 172513 - DNA, 2142 bp, Homo sapiens
  Payload ID: 13919
  Gene Symbol:
  Gene Name: Putative eukaryotic translation initiation factor 2 subunit 3-like protein  [Source:UniProtKB/Swiss-Prot
  Acc:Q2VIR3]
  ENST ID: ENST00000322446
  CDS Start-End: 302-1702
acccgcctcgcatgggcccagggggcgggggtttgggtggctgccctcagtattgcctgcacaaatatctaccaagtctgcgacgaatagctccagcaactttgcaccgtgttttccagtaagcctaccgacaggcactgtgcagattcaagcagagagaagtccaagcactgaggccgctgctgcaccggccatcctgagaccctagtcgaccttccggcctccgcatccccgccccgcactaggacccctgcagacgatcaggcggcagccggggtgactttcttcctcttttggcaacatggcgggcggagaagctggggtgactctggggcagccgcacctttcgcgtcaggatctcaccaccttggatgttaccaagttgacgccactttcacacgaagttatcagcagacaagccacaattaatataggtacaattggtcatgtagctcatgggaaatccacagtcgtcaaagctatttctggagttcacaccgtcaggttcaaaaatgaactagaaagaaatattacaatcaagcttggatatgctaatgctaagatttatcaacttgatgacccaagttgccctcggccagaatgttatcgatcttgtgggagcagtatgcctgatgagtttcctacagacattccaggaaccaaagggaacttcagattagtcagacatgtttcctttgttgactgtcctggccacgatattttgatggctactatgctgaacggtgcagcagtgatggatgcagctcttctgttgatagctggtaatgaatcttgccctcagcctcagacatctgaacacctggctgctatagagatcatgaaactgaagcatattttgattctacaaaataaaattgatttggtaaaagaaaggcaggctaaagaacaatacgagcagatccttgcgtttgtccaaggtacagtagcagagggagctcccattattccaatttcggctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagacagaagtaagacctggtattgtttccaaagatagtgaaggaaaactcatgtgtaaatcaatcttttccaaaattgtttcactttttgcggagcataatgatctgcaatatgctgctccaggcggtcttattggagttggaacaaaaattgaccccactttgtgccgggctgacagaatggtggggcaaatacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcgacaggagggagagttagtgctgtcaaggccgatttgggcaaaattgttttgaccaatccagtgtgcacagagattcatctaattcaccttgatttgattaaggaattagaatggggcccagttcttaccaatgagacacagaggaagtctgcagcaaacttctaggaaatcatttctttctttaaagaaaaaagacaaaagaaaacatgatcccctttctgctctggagattctttgcaggctgtgatgcccggaattgtgacaaccatatcacaattatgggaagaacttaggttcctgaaaatcttattgcaacatgtttacagccagccctacacctggacttcatgtttattatttatatcagtccaagttcttgaaatgatgctgctttcatctgaaatacacaaacaaataaaattatatttatatacacataaacatgtatatacatacatgtatatatttttatagagtattagaatgctactctttctcaaaatatgttaaatataaactaaacttgactgttaattatgatgtgtcctaatttaattatatgaaaaattctgatgtttaaaaaataaaaaatgaagttatattga

SEQ ID NO: 172514 - DNA, 1602 bp, Homo sapiens
  Payload ID: 13919
  Gene Symbol:
  Gene Name: Putative eukaryotic translation initiation factor 2 subunit 3-like protein  [Source:UniProtKB/Swiss-Prot
  Acc:Q2VIR3]
  Uniprot ID: Q2VIR3
  ENST ID: ENST00000538173
  CDS Start-End: 14-1432
ctcttttggcaacatggcgggcggagaagctggggtgactctggggcagccgcacctttcgcgtcaggatctcaccaccttggatgttaccaagttgacgccactttcacacgaagttatcagcagacaagccacaattaatataggtacaattggtcatgtagctcatgggaaatccacagtcgtcaaagctatttctggagttcacaccgtcaggttcaaaaatgaactagaaagaaatattacaatcaagcttggatatgctaatgctaagatttatcaacttgatgacccaagttgccctcggccagaatgttatcgatcttgtgggagcagtatgcctgatgagtttcctacagacattccaggaaccaaagggaacttcagattagtcagacatgtttcctttgttgactgtcctggccacgatattttgatggctactatgctgaacggtgcagcagtgatggatgcagctcttctgttgatagctggtaatgaatcttgccctcagcctcagacatctgaacacctggctgctatagagatcatgaaactgaagcatattttgattctacaaaataaaattgatttggtaaaagaaaggcaggctaaagaacaatacgagcagatccttgcgtttgtccaaggtacagtagcagagggagctcccattattccaatttcggctcagctgaaatacaatattgaagttgtttgtgagtacatagtaaagaaaattccagtacccccaagagactttacttcagagccccggcttattgttattagatcttttgatgtcaacaaacctggctgtgaagttgatgaccttaagggaggtgtagctggtggtagtatcctaaaaggagtattaaaggtgggccaggagacagaagtaagacctggtattgtttccaaagatagtgaaggaaaactcatgtgtaaatcaatcttttccaaaattgtttcactttttgcggagcataatgatctgcaatatgctgctccaggcggtcttattggagttggaacaaaaattgaccccactttgtgccgggctgacagaatggtggggcaaatacttggtgcagtcggagctttacctgagatattcacagaattggaaatttcctatttcctgcttagacggcttctaggtgtacgcactgaaggagacaagaaagcagcaaaggttcaaaagctgtctaagaatgaagtgctcatggtgaacataggatccctgtcgacaggagggagagttagtgctgtcaaggccgatttgggcaaaattgttttgaccaatccagtgtgcacagaggtaggagaaaaaattgcccttagccgaagagttgaaaaacactggcgtttaattggttggggtcagataagaagaggagtgacaatcaagccaacagtagatgatgactgaagaataccggttaaataatacattcggatggagctggaagttgcaatttctctttaacaaccaaggggtttattttcaaagcgatattggggaattgatttcacagtttgttaccttagtaggtaacggtaaggttattctctctttttttttttggttatgaaaactta

SEQ ID NO: 172515 - DNA, 2747 bp, Homo sapiens
  Payload ID: 13920
  Gene Symbol: PHTF1
  Gene Name: putative homeodomain transcription factor 1
  Uniprot ID: Q9UMS5
  ENST ID: ENST00000357783
  CDS Start-End: 600-2513
gtcactgcatcccggcgcggcccgcagaagacgagcgccgctgccgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggtaaaagtttcacatctgctttaaggaaaaatgaaaattctattatagagttcactttctgttttagacttaggtcactgtccttaagtatgtatttttaatgcatctacattttttactattttggatgtttggtaatttttctaacttttcaaaatgggaatacaagtaattctgaagtcctttcaaactgtaagatcgctctaattttagttggtaattattaattgataataaaactatcatatggttgcaaaa

SEQ ID NO: 172516 - DNA, 3000 bp, Homo sapiens
  Payload ID: 13920
  Gene Symbol: PHTF1
  Gene Name: putative homeodomain transcription factor 1
  ENST ID: ENST00000369598
  CDS Start-End: 347-2500
tggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagtaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagact

SEQ ID NO: 172517 - DNA, 3075 bp, Homo sapiens
  Payload ID: 13920
  Gene Symbol: PHTF1
  Gene Name: putative homeodomain transcription factor 1
  ENST ID: ENST00000369600
  CDS Start-End: 446-2575
gctgccgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagtaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagact

SEQ ID NO: 172518 - DNA, 3273 bp, Homo sapiens
  Payload ID: 13920
  Gene Symbol: PHTF1
  Gene Name: putative homeodomain transcription factor 1
  Uniprot ID: Q9UMS5
  ENST ID: ENST00000369604
  CDS Start-End: 485-2773
gtcactgcatcccggcgcggcccgcagaagacgagcgccgctgccgccgcctcctcctcccgggctcccgggctctcggggtccggggcctttgcacctgtcttttccagctgggcacaaagccttttgctgtcgccgtggcgactggaggccttcacttttaatccccctcattttccagttcattctctgcttattttctggtcagtccgtgaccctgtaggcggcctctgaccggcgatcgatttgccgccctcagggcgctgggcggccggctgcctccgaagctggggcggcctccgcggtctccatggtaacggcctctccggcgtctccgcctggaggggaagatgcggcctgcctggcccgccgcctcgcccccggcctcacggtgggaccccgggcactgaggacggaggtcccgggcgccggcccgcggggcaacgggcactagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagtaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagact

SEQ ID NO: 172519 - DNA, 3244 bp, Homo sapiens
  Payload ID: 13920
  Gene Symbol: PHTF1
  Gene Name: putative homeodomain transcription factor 1
  Uniprot ID: Q9UMS5
  ENST ID: ENST00000393357
  CDS Start-End: 453-2741
ctctccggcgtctccgcctggaggggaagatgcggcctgcctggcccgccgcctcgcccccggcctcacggtgggaccccgggcactgaggacggaggtcccgggcgccggcccgcggggcaacgggcactaggtgagagccggacgcgggcgagcgaaggaggcgggtgccgggcgactccagcggcggcccctgcccctcccccgcacccacgaacacgctcgcccgatatattgcagaggcttctccggtcgccgctgcgccagtttttttttgtttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttactactttatttcatgcaagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaagaaaattacgaaaaactgtaaatggtgatgggagccgagaaaatggaaataactcctctgataaagtcagaggaatagaaactttggaatctgtacccattattggtggtttttgggagactatctttggcaacaggattaaaagagtaaaattaatatctaacaaagggactgaaactgacaatgacccaagttgtgtccatcctatcattaagaggagacaatgtcgaccagagattagaatgtggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacagagatttttatttgcaaaactcttcagccatattacttctgccaggaaagctaggaaatatgaaatacctcatttcagacttaagaaggtggagaatattaaaatatggttatcactgcgttcctatctaaagagacgggggccacagcgttcagttgatgtggttgtatcctcggttttcctactgacactttcgattgctttcatttgttgtgctcaggttctccaaggacataaaactttcctgaatgatgcttataactgggagtttttgatctgggaaacagctttactactttttttattgcgtctggcctcactggggtctgaaaccaataagaaatacagcaatgtttcaatattacttacagaacagattaatttatatcttaagatggaaaaaaagccaaataagaaagaacagcttactctagtaaacaatgtattaaagctgtccaccaagttgttgaaagagctggacacaccatttagactctatggactgacaatgaatcccttaatctacaatatcacaagagtagttatcctttctgctgtctcaggtgttataagtgatcttctaggatttaatataagactgtggaaaattaaatcataagctgagtaaatgcctggactctcccctggctggtatcaaaacttacctatcaaggaaagtgatgactgcagaaaccagtgagatacccacctgcttgttcacatgcacaggtgctctcagctctgccaaagcgaatgaatggtgtttccggaggagcaagtccttttccaactgggtgtgcatgctaaaaacctgtattttcatgcttttcaaacaacatgaatagtcagctgactaaagactgtgtgtgttgtggtaacacaaagacaattttgtaagtttgcgcttcagtactgtgacagttatgtttactggacatagtcttttgggcaactatgatagatgcccaaagcatgaagcaaatatcttttattggaaatatgcaaattcaatacttttccattatagtctatagaactggagatttcatttctctatcaaagagagatcaagcgaactattttaggttaaatccgaataaaagaactttactggagactttc

SEQ ID NO: 172520 - DNA, 770 bp, Homo sapiens
  Payload ID: 13920
  Gene Symbol: PHTF1
  Gene Name: putative homeodomain transcription factor 1
  ENST ID: ENST00000446739
  CDS Start-End: 456-770
ggcctctccggcgtctccgcctggaggggaagatgcggcctgcctggcccgccgcctcgcccccggcctcacggtgggaccccgggcactgaggacggaggtcccgggcgccggcccgcggggcaacgggcactaggtgagagccggacgcgggcgagcgaaggaggcgggtgccgggcgactccagcggcggcccctgcccctcccccgcacccacgaacacgctcgcccgatatattgcagaggcttctccggtcgccgctgcgccagtttttttttgtttgtttgttgtgttttccctggcaaacagctggagaaagagcagctcatggagaggctgagagaagcggttttcgcgtcctacccaaactgggagagtaaccttcagcagctggactcaccgattggttttccttcattttcagtgaaatcccattctctggctggagacacagatggcctcaaatgagagagatgctatatcgtggtaccaaaagaagattggagcctacgatcagcagatatgggaaaagtcaatcgaacagactcagattaagggtttgaaaaacaaaccgaaaaagatgggccacataaagccagacttgattgacgttgacttaatcagagggtcaacatttgccaaagcaaaacctgaaattccatggacatctctgactcggaaggggcttgttcgagttgtattttttccattgttcagcaattggtggattcaggttacctctttaagaatctttgtttggctgttacta

SEQ ID NO: 172521 - DNA, 1063 bp, Homo sapiens
  Payload ID: 13920
  Gene Symbol: PHTF1
  Gene Name: putative homeodomain transcription factor 1
  ENST ID: ENST00000412670
  CDS Start-End: 1-995
ggcaaacaagagagaaagcaaaattttcagatggagaaaagtgccgtagggaggcttttaggcgtttgggtaatggggtgtctgatgacctgtcaagtgaagaagatggtgaagcacggacacagatgatattattgcgtaggagtgtggaaggggcctcaagtgacaatggttgtgaagttaagaatagaaaatcaatactttcaaggcacctaaactctcaggtaaagaaaaccactacaaggtggtgtcatattgtgcgggattcagatagtctggctgaatcagaatttgaatcagcagccttcagccagggctctagatcgggtgtgagtggtggctctcgaagcctcaacatgtcaagaagagactcagaaagcacccgccatgactcggagactgaggacatgttatgggacgacctgctacatggcccagagtgccggtcatctgtcaccagtgacagtgagggggcccatgtgaatacccttcactcagggaccaaacgtgaccccaaagaggatgtttttcagcagaatcatttattctggcttcagaattcaagtccttcctctgatcgagttagtgcaataatctgggaggggaatgagtgcaaaaagatggatatgtctgtgttggaaataagtggcatcatcatgagcagggtcaatgcctatcagcaaggagtaggttatcagatgctgggaaatgttgtcactattggattagcattttttccattcttacatcgacttttccgtgagaagagccttgaccaactaaagtccatttcagctgaggagatcttgactctcttttgtggggcaccacctgttacacctattattgttttgtcgataattaatttttttgaaagattgtgtcttacttggatgttttttttcatgatgtgtgtggcagagagaacatataaacaggtcagtggagaaataaggaaaattttttacctgtttttgtatatgatattccattgagttgcttttgttctcttgatttggtctctcttcaagttgatgtgggcaataaaggattgataagtgga

SEQ ID NO: 172522 - DNA, 4778 bp, Homo sapiens
  Payload ID: 13921
  Gene Symbol: PHTF2
  Gene Name: putative homeodomain transcription factor 2
  Uniprot ID: Q8N3S3
  ENST ID: ENST00000248550
  CDS Start-End: 77-2434
tgggaaataaagtcatttgtatgtttttctctcttgcacagcctaaaatgaccaatgtgtgatttcagtggaataaatggcgtccaaagtcacagatgctatagtctggtatcaaaagaaggagtttctctctgtggccaccaccgccccaggcccacagcaagtactgcctggctactgccagtgttcactcaaggaccaagggctcttcattcagtgtttgattggagcatatgatcaacaaatatgggaaaaatctgttgaacagagagaaatcaagtttattaaactggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacagataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatggtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgac

SEQ ID NO: 172523 - DNA, 4541 bp, Homo sapiens
  Payload ID: 13921
  Gene Symbol: PHTF2
  Gene Name: putative homeodomain transcription factor 2
  Uniprot ID: Q8N3S3
  ENST ID: ENST00000275575
  CDS Start-End: 107-2194
ggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatggtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactga

SEQ ID NO: 172524 - DNA, 4793 bp, Homo sapiens
  Payload ID: 13921
  Gene Symbol: PHTF2
  Gene Name: putative homeodomain transcription factor 2
  Uniprot ID: Q8N3S3
  ENST ID: ENST00000307305
  CDS Start-End: 203-2446
tccggcgcaaaatcctgcgggagagggggtggggcaaccctctggaggcagcgcgcccgcgggcagcctcgttgtggctccttgggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacagataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatggtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactga

SEQ ID NO: 172525 - DNA, 2516 bp, Homo sapiens
  Payload ID: 13921
  Gene Symbol: PHTF2
  Gene Name: putative homeodomain transcription factor 2
  Uniprot ID: Q8N3S3
  ENST ID: ENST00000450574
  CDS Start-End: 127-1197
aagtaaccagagtgctatgtctgcatgctgttcagtctccttttggaaggtgggaaataaagtcatttgtatgtttttctctcttgcacagcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaagtttattaaactggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggtatatactttgtccttaagtgtatacatacgtatctattttatatgttactaatttataacttctttcaacaattaaaaattgttgaaataaatatttcacattattatcaatatttattattgttgtatgatctggatttataaaatagcagttttaggtttacgtattgcacatgtattgatagatagccacacatttgagctcattttatgcattatctttgaagactcatacattgtttgttgtttgcttttaaagaagaacattctggagagagaatctgcaaactcctgtgttcactttttccacaatttgaaaggctttatacatttgatcatagcaaagttattttaagtaacttccttcatattgctgtcaccagttattaagtccccatacttcaaaattcagttcttttttctttgtttctatttttccttattaatctttattttctctaaacccttttcaactatatcatatctcttgagcttcaaattgtttaaataaagaatttcattcaattgtattttcagtttctaatctaagggtagaacatttggctttaaggcaaataaattacactgtttatcacttttttataaacattaccttctactctttttgagctatgttagtaattttttccttgatggttttgggttaaacttgtaaaacaaacacatgttacgctgtgctggaatatgattgccttcagagtattaagattagaagagttactattctttgcacactcttctttgtggttgtgtctctggttaatctttctggtgattgtggttttgtttcttttcccagtggttgccatacagacactaatgccagtgtgtctgctctattgcctcttcacccatgtcatttgatgtagtgtttcttgttcctaagccagataaccaagcttgtaaaattttgtcttactgtatgtactgttagaagtcagttggtgctggaagggagacggagggctgtttgacccctctcccagaataaattatttagcagtagcagtatttttctcactccatgatcttggcttttgttggtttgcaactgtattttaaacgattgagtttcttgaagcgcagaacattattctacctattaacttttaaattaaaaggttgtttaaaatcttgatttccagctaagtaaggctgatagtaagcattgatttacatcttttttaatgatataagaaattacataaatataaaatatggctataaaattcttcgtctataaagtgaagaatgtagactaggtgatattttaaaagctgcattcagttctcaaaaatttttactcttaaaccagctttaaagggcgtttctaaaaaaaagcaaaataaa

SEQ ID NO: 172526 - DNA, 5198 bp, Homo sapiens
  Payload ID: 13921
  Gene Symbol: PHTF2
  Gene Name: putative homeodomain transcription factor 2
  Uniprot ID: Q8N3S3
  ENST ID: ENST00000416283
  CDS Start-End: 216-2573
agtgactgcaggctccggcgcaaaatcctgcgggagagggggtggggcaaccctctggaggcagcgcgcccgcgggcagcctcgttgtggctccttgggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaaggagtttctctctgtggccaccaccgccccaggcccacagcaagtactgcctggctactgccagtgttcactcaaggaccaagggctcttcattcagtgtttgattggagcatatgatcaacaaatatgggaaaaatctgttgaacagagagaaatcaagtttattaaactggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacagataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatggtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccaccccacccccattatataagggctattttagatgcttttaacctccccaacaaataatttgccaagtgtccaatgagaacttatcatgttggtgtgttaggtaaatcgggcaaatatgatagtgtcttacattgggccttgattttaagttgttatatttgtacaatcgagtattttagaaattacatgaaacatgaaacagtttttgcaattttttttaaactgggcatctggtttctaaaaatttatttgaaacaatctagaattttcttggtgcaaagtgtatcatgtggaatatcctcatatttttaccatattttaagaactttaagacgattaattgtaaataatttatttgattggtgcagttctaatccctaaatcataatcttaaaatcaggaatgtgtggagaacagagccatgtcatatcactttgctcttaccattccttttgatcagcctcaattcagcctcattgtgtagtatgttttttctttctatgaaaaacaacagaaagcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactgacggtgtttttttttttaattttcaggtcatatacatttctatggtaattttgtgtttacttaacataaaatttagttagatttggggggagtgaaaataaattttttataactttccaacattttagattttgttatgattcttagaacatgaaagaataatacacaggtttttcatcaccaaaatgatattatatcattaatgtttgtttgcttctttgtttttgaatacagcaaactggctgtggcctgaaatattaaagctcattgtgaaaagat

SEQ ID NO: 172527 - DNA, 3525 bp, Homo sapiens
  Payload ID: 13921
  Gene Symbol: PHTF2
  Gene Name: putative homeodomain transcription factor 2
  Uniprot ID: Q8N3S3
  ENST ID: ENST00000422959
  CDS Start-End: 203-2458
tccggcgcaaaatcctgcgggagagggggtggggcaaccctctggaggcagcgcgcccgcgggcagcctcgttgtggctccttgggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaagtttattaaactggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacagcgattactttttgcaaaactctttggacatttaacatctgcaaggagggctcgaaaatctgaggttcctcatttccggttgaagaaagtacagaatataaaaatgtggctatctctccgttcctatcttaagcgtcgaggtcctcagcgatcagttgatgtaatagtttcatctgctttcttattgactatctcagttgtatttatctgttgtgcccagctacttcatgtacacgagatcttccttgattgtcactacaattgggaattggtaatctggtgcatctcgttaacactttttctcctaagatttgttacccttggatcagaaacaagtaaaaaatatagtaatacctcaatattacttactgaacagataaacctctacttgaaaatggagaaaaaacctaacaaaaaggaggaactgacactagtgaataatgttttaaaactggctactaaactgctaaaggagttggacagtccttttagattatatgggcttacaatgaatccgctgctttataacatcacccaggttgttatcctgtcagctgtttctggtgttatcagtgacttgcttggatttaatttaaagctatggaagattaagtcatgacaattcaaagaaaagaagatgtagcctcttttccagaataagagtactgactaagctgcctgaaagcttgtcactgattctttgcttcaggagtctcagctagggagttgaagtgtttacatcagactgtcttgtgcaattcttatatttattttactggttcacttttttttacatttattttagtctttatatttttatttttaagcattgatgtacttagttgttgaaagggtgatgaaactgatatccagatacttgagatcctggtaattggtcataaataattggcaaaataacaaattgtgaaaatagaagccattgctcagcaccgtttctccatcaatgccgtgaacttgccttacttgaggaaaaattctttaactttggaatattgcattgaactcagctatacacataaaacattttctttggtaaatcaagatccagtcagggtttctcttgaattattttggaacaatgccaggatccaaactgattaagttacagtttaagcacccttcagtattaatatatacggtattatataacaggtcaacaagtgctctttgatgataaaacttgtaatagagcaataattgtaaatggttaccatactgtaagatattttgataaaaattaactagtaatacttgtatttatttgaaacactgggctgtttgcacagctccaactgtgcatgctcaaaatgtgcactttttaaaattgttacttttaatgcgtatctttatatgggatctgttatagtatactagggcatgatatggtatccttttgagtgaggtatatactcatctcacaagtgaagtgcctactgatattactaaagtacattatgtttactcaagtaaataattttctccccatggtacactctagtgtaggctattcataccacactgaaatgaacaactgaagaataaggctaagaaccaataaaatatttctctaattgctagttgtaaaactgtatccaaattttcagaaaagacagcttcagcttgcaaattctatcctctaaacttatctggtgcattctccccacc

SEQ ID NO: 172528 - DNA, 1977 bp, Homo sapiens
  Payload ID: 13921
  Gene Symbol: PHTF2
  Gene Name: putative homeodomain transcription factor 2
  Uniprot ID: Q8N3S3
  ENST ID: ENST00000424760
  CDS Start-End: 195-1835
aaaatcctgcgggagagggggtggggcaaccctctggaggcagcgcgcccgcgggcagcctcgttgtggctccttgggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggacgcccctaaatcgggtactagttgcagctctcgctgttcaagttccagacaggattctgagagtgcaaggccagaatctgaaacagaagatgtgttatgggaagacttgttacattgtgcagaatgccattcatcttgtaccagtgagacagatgtggaaaatcatcagattaatccatgtgtgaaaaaagaatatagagatgacccttttcatcagagtcatttgccctggctccatagttcccacccaggattagaaaaaataagtgctatagtatgggaaggtaatgattgtaagaaagcagacatgtctgtacttgaaatcagtggaatgataatgaacagagtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacaggtgggtataatgtagacttccgaataagaatattttatcgttttcataatattaaaagtattcctgaagtactttattatttcattatatcatttttacctaattattttttattttgcttttatagtacctaaccaaataaaatcttaacaattca

SEQ ID NO: 172529 - DNA, 1738 bp, Homo sapiens
  Payload ID: 13921
  Gene Symbol: PHTF2
  Gene Name: putative homeodomain transcription factor 2
  Uniprot ID: Q8N3S3
  ENST ID: ENST00000415251
  CDS Start-End: 120-1178
gggctctgttggcggcggcgctagcttcggagtctcccgcgcgcacctcagccgcctcctagcggcgcggcgctcgctcctacgcctaaaatgaccaatgtgtgatttcagtggaataaatggcgtccaaagtcacagatgctatagtctggtatcaaaagaagattggagcatatgatcaacaaatatgggaaaaatctgttgaacagagagaaatcaaggggctaaggaataaaccaaagaaaacagcacatgtgaaaccagacctcatagatgttgatcttgtaagagggtctgcatttgcaaaggcaaagcctgaaagtccttggacttctctgaccagaaagggaattgttcgagttgtatttttcccctttttcttccggtggtggttacaagtaacatcaaaggtcatctttttctggcttcttgtcctttatcttcttcaagttgctgcaatagtattattctgctccacttctagcccacacagcatacctctgacagaggtgattgggccgatatggctgatgctgctcctgggaactgtgcattgccagattgtttccacaagaacacccaaacctcctctaagtacagggggtaaaagaagaaggaaattaagaaaagcagcccatttggaagtacatagggaaggagatggttctagtaccacagataacacacaagagggagcagttcagaaccacggtacaagcacctctcacagcgttggcactgtcttcagagatctctggcatgctgctttctttttatcaggatcaaagaaagcaaagaattcaattgataaatcaactgaaactgacaatggctatgtatcccttgatgggaagaagactgttaaaagcggtgaagatggaatacaaaaccatgaacctcagtgtgaaactattcgaccagaagagacagcctggaacacaggaacactgaggaatggtcctagcaaagatacccaaaggacaataacaaatgtctctgatgaagtctccagtgaggaaggtcctgaaacaggatactcattacgtcgtcatgtggacaggacttctgaaggtgttcttcggaatagaaagtcacaccattataagaaacattaccctaatgaggtatatactttgtccttaagtgtatacatacgtatctattttatatgttactaatttataacttctttcaacaattaaaaattgttgaaataaatatttcacattattatcaatatttattattgttgtatgatctggatttataaaatagcagttttaggtttacgtattgcacatgtattgatagatagccacacatttgagctcattttatgcattatctttgaagactcatacattgtttgttgtttgcttttaaagaagaacattctggagagagaatctgcaaactcctgtgttcactttttccacaatttgaaaggctttatacatttgatcatagcaaagttattttaagtaacttccttcatattgctgtcaccagttattaagtccccatacttcaaaattcagttcttttttctttgtttctatttttccttattaatctttattttctctaaacccttttcaactatatcatatctcttgagcttcaaattgtttaaataaagaatttcattcaattgtattttcagtttctaatctaagggtagaacatttggctttaaggcaaataaattacactgtttatcacttttttataaacatta

SEQ ID NO: 172530 - DNA, 3584 bp, Homo sapiens
  Payload ID: 13922
  Gene Symbol:
  Gene Name: Putative NPIP-like protein LOC613037  [Source:UniProtKB/Swiss-Prot
  Acc:A6NJU9]
  Uniprot ID: A6NJU9
  ENST ID: ENST00000520915
  CDS Start-End: 76-3492
tcctgtttcacacagaagaaaactgaggttaaaaggggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcctgagtgtctgctcactccccttccaccctcagcggatgataatctcaagacacctcccgagtgtctgctcactccccttccaccctcagctccaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccttccaccctcagcggatgataatctcaagacaccttccgagcgtcagctcactccccttccaccctcagctccactctcagcagatgataatatcaagatacctgctgagcgtctgcggattccgcttccaccatcagccgatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcggggagcgtctgcgggggccgcttccaccctcagcggatgataatctcaagacaccttccgagcgtcagctcactccccttccaccctcagctccaccctcagcagatgataatatcaagacacctgccgagcgtctgcggaggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttctgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccaaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcatcacccgaacccaagaggcggaggttgagctgagaagaggccagtgcactcaagcctgagcaataagaataaaaccgagtagaacaaaataaaaaattcaaaaaacaaaacaaaacccacactcc

SEQ ID NO: 172531 - DNA, 1342 bp, Homo sapiens
  Payload ID: 13922
  Gene Symbol:
  Gene Name: Putative NPIP-like protein LOC613037  [Source:UniProtKB/Swiss-Prot
  Acc:A6NJU9]
  ENST ID: ENST00000543463
  CDS Start-End: 33-1295
aaacattccctcctttggccctacaggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtgtgctcactccccttccaccctcagcggatgataatctcaagacacctcccgagtgtgtgctcactccccttccaccctcagcggatgataatctcaagacacctcctgagtgtctgctcactccccttccaccctcagcggatgataatctcaagacacctcctgagtgtctgctcactccccttccaccctcagcggatgataatctcaagacacctcccgagtgtctgctcactccccttccaccctcagctccaccctcagctccaccctcagcggatgataatctcaagacacgtgccgagtgtctgctccatccccttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagcggatgataatctcaagacaccttccgagcgtcagctcactccccttccaccctcagctccaccctcagcagatgataatatcaagacacctgccgagcgtctgcgggggccgcttccaccctcagccgatgataatctcaagacacctcccttagctactcaggaggctgaggcagaaaaaccacgcaaacccaagaggcagagggcggctgagatggaaccacctcccgaacccaagaggcggagggtcggtgacgtggaaccgtcacgcaaacccaagaggcggagggccgctgacgtggaaccatcatcacccaaacccaagaggcggagggtcggtgatgtggaaccgtcacgcaaacccaagaggcggagggccgctgacgtggaaccatcatcacccgaacccaagaggcggagggtcggtgacgtggaaccgtcacgcaaacccaagaggcggagggccgctgacgtggaaccatcatcacccgaacccaagaggcggaggttgagctgagaagaggccagtgcactcaagcctgagcaataagaataaaaccgagt

SEQ ID NO: 172532 - DNA, 797 bp, Homo sapiens
  Payload ID: 13922
  Gene Symbol:
  Gene Name: Putative NPIP-like protein LOC613037  [Source:UniProtKB/Swiss-Prot
  Acc:A6NJU9]
  ENST ID: ENST00000562937
  CDS Start-End: 1-207
catgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaaggtttctcaccttctcctctcctcactctcaccaagggctgaggtccatttgtatgcacacaaagaaaagagtttcttcctttcgaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaactaagcgtgaaagaatgtgagcatgcagaaaaggagaggcaggtatcagaggcagaggaaaatgggaaattggatatgaaagaaatacacacctacaagaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtgtgctcactccccttccaccctcagcggatgataat

SEQ ID NO: 172533 - DNA, 570 bp, Homo sapiens
  Payload ID: 13922
  Gene Symbol:
  Gene Name: Putative NPIP-like protein LOC613037  [Source:UniProtKB/Swiss-Prot
  Acc:A6NJU9]
  ENST ID: ENST00000568053
  CDS Start-End: 319-570
gctaaaaatatggtggacctggcattacagctattacaaatctcctaagatgtctcgggtagtgtattagttacttttcatactgctatgaagaaatactggaaactgggtaatttataaagaaaaagaggtttaatgtactcacagttccacaaggctggagaggcctcagaatcatggtggaaggcaaggagcaaaaaggtatgatctcgtgaaaccttgagagaaactgaatgacgaatgaaactattgttcctgtttcacacagaagaaaactgaggttggcactcatcatgagcccctgttctcattctgcaaatggtgaagctctctattgtcctgaccccacagttcctgtcccatgaccagggccagctcaccaaggagctgcagcagcatgtaaagtcagtgacatgcccatgcgagtacctgaggaaggttatcaatactctggctgaccatcatcatcgtgggactgactttggtggaagtccttggttacatgtcattattgcgtttccgacaagttataaagttgtcattaccctctggatagtttacctttgggtg

SEQ ID NO: 172534 - DNA, 519 bp, Homo sapiens; identical to SEQ ID NO: 160653
  Payload ID: 13922
  Gene Symbol:
  Gene Name: Putative NPIP-like protein LOC613037  [Source:UniProtKB/Swiss-Prot
  Acc:A6NJU9]
  ENST ID: ENST00000564219
  CDS Start-End: 63-212

SEQ ID NO: 172535 - DNA, 543 bp, Homo sapiens; identical to SEQ ID NO: 160667
  Payload ID: 13922
  Gene Symbol:
  Gene Name: Putative NPIP-like protein LOC613037  [Source:UniProtKB/Swiss-Prot
  Acc:A6NJU9]
  ENST ID: ENST00000564502
  CDS Start-End: 257-379

SEQ ID NO: 172536 - DNA, 1216 bp, Homo sapiens
  Payload ID: 13922
  Gene Symbol:
  Gene Name: Putative NPIP-like protein LOC613037  [Source:UniProtKB/Swiss-Prot
  Acc:A6NJU9]
  ENST ID: ENST00000618637
  CDS Start-End: 55-807
agccacctccacctctgtcctggccgcctcagggcgccctgaaaggaccaggacatgcgggtgcggtggatgctcttttggctcctctttgggctcctactggaatttatcagccatcagtgcatctctgttatcaatactctggctgaccatcatcatcgtgggactgactttggtggaagtccttggttacatgtcattattgcgtttccgacaagttataaagttgtcattaccctctggatagtttacctttgggtgtctctcctgaagactatcttctggtctcgaaatggacatgatggatccacggatgtacagcagagagcctggaggtccaaccgccgtagacaggaaggaaataaaattggcctgaaagacgtcattactctacggagacatgtggaaacaaaagttagagctaaaatccgtaagaggaaggtgacaacgaaaatcaaccatcatgacaaaatcaatggaaagaggaagaccgccagaaaacagaaaatgtttcaacgtgcgcaagagttgcggcggcgggcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccgtgcctaagtgacttcttgaggtgagattgttctgtcagaaaaccctctcccagttcccctgcagctctt

SEQ ID NO: 172537 - DNA, 1194 bp, Homo sapiens
  Payload ID: 13923
  Gene Symbol:
  Gene Name: Putative NPIP-like protein LOC729978  [Source:UniProtKB/Swiss-Prot
  Acc:A6NJ64]
  Uniprot ID: A6NJ64
  ENST ID: ENST00000399147
  CDS Start-End: 1-1194
atgttttgttgcttaggatatgaatggctgagcggaggctgtaaaacctggcactctgcttgggttatcaatactctggctgaccatcatcatcgtgggactgactttggtggaagtccttggttacgtatcattattgcatttccgagaagttataaagttgtccttaccctctggacagtttacctttggttgtctttcctgaagactatcttccagtctgaaaatggacatgatgtatccacagatgtacagcagagagccaggaggtccaaccgccgtagacaggaagggctgaggtccatttgtatgcacacaaagaaaagagtttcttcctttccaggaaataaaattggcctgaaagacgtcattactctacggagacatgtggaaacaaaaggtagagctaaaatccgtaagatgaaggtgacaacgaaaatcaaccatcatgacaaaatcaatggaaagaggaagaccgccaaaaaacagaaactaagcgtgaaagaatgtgagcatgcagaaaaggagaggcaggtgtcagaggcagaggaaaatgggaaattggatatgaaagaaatacacacctacatgaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtctgctcactccccttccaccctcagctccaccctcagcggatgataatctcaagacacctcccttagctactcaggaggctgaggcagaaaaaccacccaaacccaagaggtggagagcggctgagatggaatcaccacccgaacccaagaggcggagggccgctgaggtggaatcaccacccgaacccaagaggcggagggccgctgaggtggaaccatcatcacccgagcccaagaggcggaggttgagtaagctgagaacaggccattgcactcaagcctga

SEQ ID NO: 172538 - DNA, 757 bp, Homo sapiens
  Payload ID: 13923
  Gene Symbol:
  Gene Name: Putative NPIP-like protein LOC729978  [Source:UniProtKB/Swiss-Prot
  Acc:A6NJ64]
  ENST ID: ENST00000538896
  CDS Start-End: 651-757
cgcagatccaagtcgccggacccggtgtggagagcggtgctgaggctacgcgggctggagactcagggttgatggacagatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcgcccagaagcagggacagggagctggttggggaggaccagaaatcaggttatcaatactctggctgaccatcatcatcgtgggactgactttggtggaagtccttggttacgtatcattattgcatttccgagaagttataaagttgtccttaccctctggacagtttacctttggttgtctttcctgaagactatcttccagtctgaaaatggacatgatgtatccacagatgtacagcagagagccaggaggtccaaccgccgtagacaggaaggaaataaaattggcctgaaagacgtcattactctacggagacatgtggaaacaaaaggtagagctaaaatccgtaagatgaaggtgacaacgaaaatcaaccatcatgacaaaatcaatggaaagaggaagaccgccaaaaaacagaaactaagcgtgaaagaatgtgagcatgcagaaaagga

SEQ ID NO: 172539 - DNA, 921 bp, Homo sapiens
  Payload ID: 13923
  Gene Symbol:
  Gene Name: Putative NPIP-like protein LOC729978  [Source:UniProtKB/Swiss-Prot
  Acc:A6NJ64]
  ENST ID: ENST00000547494
  CDS Start-End: 1-921
atgttttgttgcttaggatatgaatggctgagcggaggctgtaaaacctggcactctgcttgggttatcaatactctggctgaccatcatcatcgtgggactgactttggtggaagtccttggttacgtatcattattgcatttccgagaagttataaagttgtccttaccctctggacagtttacctttggttgtctttcctgaagactatcttccagtctgaaaatggacatgatgtatccacagatgtacagcagagagccaggaggtccaaccgccgtagacaggaaggaaataaaattggcctgaaagacgtcattactctacggagacatgtggaaacaaaaggtagagctaaaatccgtaagatgaaggtgacaacgaaaatcaaccatcatgacaaaatcaatggaaagaggaagaccgccaaaaaacagaaactaagcgtgaaagaatgtgagcatgcagaaaaggagaggcaggtgtcagaggcagaggaaaatgggaaattggatatgaaagaaatacacacctacatgaaaatgtttcaacgtgcgcaagagttgcggcggcgggcagaggactaccacaaatgcaaaatccccccttctgcaagaaaggctctttgcaactgggtcagaatggcggcagcggagcatcgtcattcttcaggattgccctactggccctacctcacagctgaaactttaaaaaacaggatgggccaccagccacctcctccaactcaacaacattctataactgataactccctgagcctcaagacacctcccgagtgtctgctcactccccttccaccctcagcggatgataatctcaagacacctcccgagtgtctgctcactccccttccaccctcagctccaccctcagcggatgataatctcaagacacctccc

SEQ ID NO: 172540 - DNA, 1216 bp, Homo sapiens
  Payload ID: 13923
  Gene Symbol:
  Gene Name: Putative NPIP-like protein LOC729978  [Source:UniProtKB/Swiss-Prot
  Acc:A6NJ64]
  ENST ID: ENST00000620285
  CDS Start-End: 55-807
agccacctccacctctgtcctggccgcctcagggcgccctgaaaggaccaggacatgcgggtgctgtggatgctcttttggctcctcttttggctcctgctggaatttatcagccatcagtccacctgtgttatcaatactctggctgaccatcatcatcgtgggactgactttggtggaagtccttggttacgtatcattattgcatttccgagaagttataaagttgtccttaccctctggacagtttacctttggttgtctttcctgaagactatcttccagtctgaaaatggacatgatgtatccacagatgtacagcagagagccaggaggtccaaccgccgtagacaggaaggaaataaaattggcctgaaagacgtcattactctacggagacatgtggaaacaaaaggtagagctaaaatccgtaagatgaaggtgacaacgaaaatcaaccatcatgacaaaatcaatggaaagaggaagaccgccaaaaaacagaaaatgtttcaacgtgcgcaagagttgcggcggcgggcagaggactaccacaaatgcaaaatccccccttctgcaagaaaggctctttgcaactgggtaagtttgcttgttttccttgcttttggacatagtctgccaggtcaggacatggatacatttttctccctacagctctgtgctcaagccctgcagagggagatggcagagagaaaggctgcctacaagcatcacagtcccatccctgttggtaaccgtgttgcgcaaaaacaccttcatccccacccagtggggcccctgatctaatattctaagtgtcagaggttccgtatttgtaatagcagatgggccctgactgtaaactagtgaagagtgaatgtaacttattacccacagggacaattccaaatgaaggccttaaatgatgctcagctaagctggttcttgtgtggcctctgtaccttcaaaagctgccgagtcctatgattacacgtgatgggacttgtacacttgaagtgaaacacagttttaaaacttgctttgtttagaattcccacctcatttttccatggacaaaagtattctttatgtcctagtgcacttacaatttggtattacctgggagtgaaaagaaatattacagccatgcctaactgacttcttgaggtgagattgttctgtcagaaaaccctctcccagttcccctgcagctctt

SEQ ID NO: 172541 - DNA, 2722 bp, Homo sapiens
  Payload ID: 13924
  Gene Symbol:
  Gene Name: Putative RNA exonuclease NEF-sp  [Source:UniProtKB/Swiss-Prot
  Acc:Q96IC2]
  Uniprot ID: Q96IC2
  ENST ID: ENST00000261377
  CDS Start-End: 210-2534
aaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagaatccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagctttatggaaacttggtatagcagctaaaagagtttagtttgtttatatggcatgtataagttttcaataaatgcctaaagttcaagcatagta

SEQ ID NO: 172542 - DNA, 2604 bp, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENST ID: ENST00000348433
  CDS Start-End: 188-2419
gcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagctttatggaaacttggtatagcagctaaaagagtttagtttgtttatatggcatgtataagttttcaataaatgcctaaagttcaagcata

SEQ ID NO: 172543 - DNA, 924 bp, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENST ID: ENST00000566276
  CDS Start-End: 287-924
gggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccggtaaccgatgcggacgaaagcccgcttatctaccattttatttactgacaactgtgaagtaacccatgaccagctgtgtgaattgctgaagtatgcagttctgggcaaatccaatgttccaaaacccagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcag

SEQ ID NO: 172544 - DNA, 586 bp, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENST ID: ENST00000568046
  CDS Start-End: 280-586
gcttttccaagtccagctgccggaagtcgctcgacttctacttccggtccgttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccggtaaccgatgcggacgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgc

SEQ ID NO: 172545 - DNA, 720 bp, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENST ID: ENST00000565340
  CDS Start-End: 290-720
ggcggcgaagccgctcggcagcaccttccttctttgccaggcagacgcccgttgtagccgttggggaaccgttgagaatccgggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaagtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaat

SEQ ID NO: 172546 - DNA, 617 bp, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENST ID: ENST00000561474
  CDS Start-End: 1-617
atggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagagatgaggatcaagtggacagagatatcaactgtctatgctgggccatttagcaaaaattgcaatctcagggctctgaagaggctgtttaaaagctttggcccagtccagtcaatgacttttgttcttgaaacccgtcaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcc

SEQ ID NO: 172547 - DNA, 566 bp, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENST ID: ENST00000568647
  CDS Start-End: 82-566
ttgccaggcagacgcccgttgtagccgttggggaaccgttgagaatccggtaaccgatgcggacggtaaagccgtttggccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttacc

SEQ ID NO: 172548 - DNA, 993 bp, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENST ID: ENST00000566518
  CDS Start-End: 62-328
ggcagacgcccgttgtagccgttggggaaccgttgagaatccggtaaccgatgcggacgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaa

SEQ ID NO: 172549 - DNA, 2549 bp, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENST ID: ENST00000566993
  CDS Start-End: 213-470
ttcaaaaagcccgcgaggctgaggggcggttgttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaagtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagaatccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtgagtcggcctgccatgtttccatgtgccatttcttaccccttgtaggcaatggcaaagaatgtggtcaggctgtagcctccccaaccagcagacagctttatggaaacttggtatagcagctaaaagagtttagtttgtttatatggcatgtataagtttt

SEQ ID NO: 172550 - DNA, 624 bp, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENST ID: ENST00000568501
  CDS Start-End: 389-624
gttgttggcagctgtggctaaggaggggagaacctctgctccccgcccgtcttctcttctgcgtttcccgggctagggggcgtggggagtggttttaggcggcgaagccgctcggcagcaccttccttctttgccaggcagacgcccgttgtagccgttggggaaccgttgagaatccgagacggggttttgccatgttgcccaggctggtcttgaactcctggacttaagcgatctgtccaccttggcctctgcaagttctgggattacagaaagcccgcttatctaccattttatttactgacaactgtgaagtaacccatgaccagctgtgtgaattgctgaagtatgcagttctgggcaaatccaatgttccaaaacccagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaa

SEQ ID NO: 172551 - DNA, 563 bp, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENST ID: ENST00000563068
  CDS Start-End: 247-563
aaccgatgcggacggtaaagccgtttgggttagagcggcgcgggtgtccagtccgcggaacggggagatcgttggcaccttcgcttttttaggggaacggggatagttcggtaaactgaattgagaagcggatccgagggaggttgaaagctgtcaagcccgtgtagctctcccgctaggaggcggcacgcgggggaataggggcgctggagtttccccagctctacctcatctttctccacagccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgag

SEQ ID NO: 172552 - DNA, 2447 bp, Homo sapiens
  Payload ID: 13924
  Gene Symbol:
  Gene Name: Putative RNA exonuclease NEF-sp  [Source:UniProtKB/Swiss-Prot
  Acc:Q96IC2]
  Uniprot ID: Q96IC2
  ENST ID: ENST00000564274
  CDS Start-End: 123-2447
agaatccggtaaccgatgcggacggtaaagccgtttgggttagagcggcgcgggtgtccagtccgcggaacggggagatcgttggcaccttcgcttttttaggggaacggggatagttcgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctcactggttgctgaaggaggctgctgtgttatggatgaactggtcaaacctgaaaacaagattctggactacctcaccagcttttcgggaatcacgaagaagattcttaacccagtgacgaccaaactcaaagatgtacagaggcagttaaaagcactgcttcctcctgatgctgtgttagtgggccactccttagatttggatctcagagcactgaaaatgatacatccatatgttattgatacatcgttgctttatgtcagagagcagggcagaagatttaagctcaagttcttagccaaagttattttggggaaggatatacagtgtccagacagacttggtcatgatgccacagaagatgctagaacaatccttgaattggctcggtatttccttaagcatggcccaaaaaagattgcagaactaaatctagaagcactagctaatcaccaagaaatacaagcagcaggccaagagcctaaaaacacagcagaagtacttcagcacccaaacacaagtgttttagaatgcttggattcagtgggtcagaagcttctttttttgacccgggagacagatgctggtgaacttccatcttccagaaattgtcaaactattaagtgtctttcaaataaagaggttcttgagcaggccagagtggaaatccccctgtttcccttcagcattgttcagttctcttttaaggccttttcacctgtcctcactgaggagatgaacaaaaggatgaggatcaagtggacagagatatcaactgtctatgctgggccatttagcaaaaattgcaatctcagggctctgaagaggctgtttaaaagctttggcccagtccagtcaatgacttttgttcttgaaacccgtcagcctcatctctgtatacagtatgaagtcctagaagctgcccagctggccatagaatccttggatggtattctggtagatggtatctgcatcaaggtgcagaggcctgtgacagagctcacgcttgattgtgacaccctcgtgaatgagctggaaggagattctgaaaaccaaggctctatatatctgtctggagtgagtgaaaccttcaaagaacagctattgcaggagccccgcctctttcttggcctggaagctgtgatcttgcctaaagatcttaaaagtggaaagcagaaaaaatactgtttcctgaaattcaaaagttttggcagtgcccagcaggccctcaacattctcacaggcaaggactggaagctgaaaggcaggcatgccctaacccccaggcacctccatgcctggctcagaggcttaccacctgaatcaacaaggctcccagggcttcgtgttgtacctcccccctttgaacaggaggccttgcagactctgaaactggaccacccgaagatagcagcctggcgctggagccggaagattggaaagctctacaacagcttgtgcccgggcactctctgcctcatcctgctgccaggaaccaagagcactcatggttcactctctggtctaggactgatgggaataaaagaggaagaagaaagcgctggcccaggcctgtgttcgtga

SEQ ID NO: 172553 - DNA, 580 bp, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENST ID: ENST00000568894
  CDS Start-End: 65-580
attcccgacactccttgcttttccaagtccagctgccggaagtcgctcgacttctacttccgccatggagccagagagggaagggaccgagagacaccccaggaaggtcagggaaagcaggcaggccccaaataagctggtcggggcagctgaggcgatgaaagccggttgggatctcgaggagagtcagcccgaggccaagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcag

SEQ ID NO: 172554 - DNA, 813 bp, Homo sapiens
  Payload ID: 13924
  Gene Symbol:
  Gene Name: Putative RNA exonuclease NEF-sp  [Source:UniProtKB/Swiss-Prot
  Acc:Q96IC2]
  ENST ID: ENST00000563617
  CDS Start-End: 382-813
cgccgtcgggggcactggattcgggcgggctctccgccctggcctctccgaacctgatccctgatcattaaaatgggaatgagtgtaataccaccttcctgcaacaaggctgtcattggctgtcactgggatagtgagtcggccgagtgcggtggctcatgcctgtaattccagcactttgggaggccgaggcgggcggatcacgagaaagcccgcttatctaccattttatttactgacaactgtgaagtaacccatgaccagctgtgtgaattgctgaagtatgcagttctgggcaaatccaatgttccaaaacccagctggtgccagctttttcatcaaaaccacctaaacaacgtagtggtttttgttctgcagggaatgagtcagctacacttttacaggttctatttggagtttggatgtcttcgaaaagcattcagacataaattccgcttgcctccaccatcatctgattttctagctgatgttgttgggctacaaactgaacaaagagctggagatctgcccaagacaatggaagggcctttaccttctaatgcaaaagccgccatcaaccttcaggatgatcccatcattcaaaagtatggctctaagaaagtgggcttgaccagatgccttctgacaaaggaggaaatgagaacgtttcactttccattacaaggttttcctgattgtgaaaactttttacttaccaaatgtaatggttctatagcagacaatagtcctctctttggacttgactgtgaaatgtgcctcacatccaaggggagagagctaacacgcatctca

SEQ ID NO: 172555 - DNA, 1781 bp, Homo sapiens
  Payload ID: 13925
  Gene Symbol:
  Gene Name: Putative short transient receptor potential channel 2-like protein  [Source:UniProtKB/Swiss-Prot
  Acc:Q6ZNB5]
  Uniprot ID: Q6ZNB5
  ENST ID: ENST00000529844
  CDS Start-End: 413-841
aagtttaaattccgctccctccacgaaagagttgtagtgagtgaaaataaatattaaaacacacggaaatgtattttcctggctgcagcacctgccatcttgcctcggtaggactcattttcaaaaacagcagcttcttgaagccccagaacgcattcctgtgctacggaagacggaagagtagctctcggggtcagaaggcgaaggtcagaaggccgaattggcgggagaataggtttggtggtccgagatccgaggcaacggtggctcctcgaggtccacggtcccgggagtaatgtgaggattcttgcttttctggaagctaacacatagtcagtgccaaagtagtgacagaagaaatcttgagaggaagcatttttgtcttgtacttgaaacagctgctgggcccaccatggctcctgtgaagatcagccatgtggtatcattttcttctcaggatcccaagtatcctgtagagaacttgctaaacccagatagtccaaggagaccttggctcggctgccctcaggacaagagtgggcaattgaaagtagaactacagctggagagggcagtgcccactggctacattgatgtgggtaactgtggctgtgcgttcctgcaaattgatgtgggccattcttcctggcccctggacagacctttcataaccctgctccctgcaaccacgctaatgtctctaactgattcaaagcaggggaagaaccgctccggggtccgcatgtttaaagatggtaaagagggcaaaagcagaaaagatgggggtggtctttatgagaaacagagatgcagtactaaagaggactgtgagtgctattaggtgtagactgtgggagggagcctgtgcaggggtttaattatatctgttgggggcaaagggtggttaaggaatggtgtgcttgtgtgtgagatttgtgtggtgaggatgcatgctagctggggagatggagatttatgaactatttatatttatatataacttgtggttcggtagggcccaatatatagaacacacacacttattgattaatatatttttgtggccaggcgtggtggctcatgcctgtaatcccagcactttgggagactgggacaagtggatcatctgaggtcaggagttcgagaccagcctggccagcatggtgaaatcccatctctactaaaaatacaaaaattagccgggcatggtggtgagtgcctttaatcccagctactggggaggctgaggcggcagaattgcttgaacctgggaggcagaggttacaatgagccaagattgggccattgcactccagcctgggtgacaagagtgaaactctgtctcaaataataataataataataacaataatatgtttttgtgggtataagtgtggatgtaggatagatgtttatgtaagtgatggaaggctacatagtggttatagttgtgtagcatataatgtttactgaatttatacaaatctctgttcactaggcactacagaaaaacataagatctgattcctagcctctagggatgtacagtctcataaggatttgtctgttttaagttggaagtatttgtaatgttgtaaaggaagagtgacattggaggggcatatgatttggagaaagtgaggtactgactggacagtgttaggaactaaagatgtggagggttggtgatatcggaatgtgataccgtgagcatgtagagcacgtggtggtgtgagggaggttgaggtcttatgatccaggaagggccaatatatatctca

SEQ ID NO: 172556 - DNA, 933 bp, Homo sapiens
  Payload ID: 13925
  Gene Symbol:
  Gene Name: Putative short transient receptor potential channel 2-like protein  [Source:UniProtKB/Swiss-Prot
  Acc:Q6ZNB5]
  ENST ID: ENST00000528511
  CDS Start-End: 10-631
cacacggaaatgtattttcctggctgcagcacctgccatcttgcctcggtaggactcattttcaaaaacagcagcttcttgaagccccagaacgcattcctgtgctacggaagacggaagagtagctctcggggtcagaaggcgaaggatcccaagtatcctgtagagaacttgctaaacccagatagtccaaggagaccttggctcggctgccctcaggacaagagtgggcaattgaaagtagaactacagctggagagggcagtgcccactggctacattgatgtgggtaactgtggctgtgcgttcctgcaaattgatgtgggccattcttcctggcccctggacagacctttcataaccctgctccctgcaaccacgctaatgtctctaactgattcaaagcaggggaagaaccgctccggggtccgcatgtttaaagatgttgatttcctggctccagcctcaggagagttatgggatcgacttcgcctgacctgctcccgacccttcacgcgtcatcagtcctttggcctggcctttctacgggtgtgttcttctctggactccttagatgactctgtggtgggtccctcagcccttctgagctctgtgctgaacaagataagagagtttaagacatgttttttctcctggagtctgaagaagatggagttagaattttcaccacttcttttgtccatcaatttgaatgatcttcagtttgcagcagatgctgaagtcagcacagtatctaattgcatgttcatcagcattgcacttcagtctgcaatgataatattctgaaggacattcatcattagaagtgaagcttctggctttaaaaagagaagacaaattatatgacacaatattacttactttttatgtttaaatgtctgaaatgttttataataaattaaaagcattaca

SEQ ID NO: 172557 - DNA, 655 bp, Homo sapiens
  Payload ID: 13925
  Gene Symbol:
  Gene Name: Putative short transient receptor potential channel 2-like protein  [Source:UniProtKB/Swiss-Prot
  Acc:Q6ZNB5]
  ENST ID: ENST00000529513
  CDS Start-End: 196-600
gaattggcgggagaataggtttggtggtccgagatccgaggcaacggtggctcctcgaggtccacggtcccgggagtaatgtgaggattcttgcttttctggaagctaacacatagtcagtgccaaagtagtgacagaagaaatcttgagaggaagcatttttgtcttgtacttgaaacagctgctgggcccaccatggctcctgtgaagatcagccatgtggtatcattttcttctcaggatcccaagtatcctgtagagaacttgctaaacccagatagtccaaggagaccttggctcggctgccctcaggacaagagtgggcaattgaaagtagaactacagctggagagggcagtgcccactggctacattgatgtgggtaactgtggctgtgcgttcctgcaaattgatgtgggccattcttcctggcccctggacagacctttcataaccctgctccctgcaaccacgctaatgtctctaactgattcaaagcaggggaagaaccgctccggggtccgcatgtttaaagatggcgtggtggctcatgcctgtaatcccagcactttgggagactgggacaagtggatcatctgaggtcaggagttcgagaccagcctggccagcatggtgaaatcccatctctactaaa

SEQ ID NO: 172558 - DNA, 564 bp, Homo sapiens
  Payload ID: 13925
  Gene Symbol:
  Gene Name: Putative short transient receptor potential channel 2-like protein  [Source:UniProtKB/Swiss-Prot
  Acc:Q6ZNB5]
  ENST ID: ENST00000533047
  CDS Start-End: 299-564
gttgtagtgagtgaaaataaatattaaaacacacggaaatgtattttcctggctgcagcacctgccatcttgcctcggtaggactcattttcaaaaacagcagcttcttgaagccccagaacgcattcctgtgctacggaagacggaagagtagctctcggggtcagaaggcgaaggagtaatgtgaggattcttgcttttctggaagctaacacatagtcagtgccaaagtagtgacagaagaaatcttgagaggaagcatttttgtcttgtacttgaaacagctgctgggcccaccatggctcctgtgaagatcagccatgtggtatcattttcttctcaggatcccaagtatcctgtagagaacttgctaaacccagatagtccaaggagaccttggctcggctgccctcaggacaagagtgggcaattgaaagtagaactacagctggagagggcagtgcccactggctacattgatgtgggtaactgtggctgtgcgttcctgcaaattgatgtgggccattcttcctggcccctggacagacctttcataaccctgct

SEQ ID NO: 172559 - DNA, 588 bp, Homo sapiens
  Payload ID: 13925
  Gene Symbol:
  Gene Name: Putative short transient receptor potential channel 2-like protein  [Source:UniProtKB/Swiss-Prot
  Acc:Q6ZNB5]
  ENST ID: ENST00000528184
  CDS Start-End: 441-588
acacggaaatgtattttcctggctgcagcacctgccatcttgcctcggtaggactcattttcaaaaacagcagcttcttgaagccccagaacgcattcctgtgctacggaagacggaagagtagctctcggggtcagaaggcgaagagatgggatttcgccatgttgcccaggctgatcttgaactcctgggctgaagatatccaccctcctcggcctcccaatgtgctgggattacaggcctgagccaccatgcctggcccaagtgttcattgatgatgagagatgggcttttcgcatcaaatcacaaaaatatgctgagtaatgtgaggattcttgcttttctggaagctaacacatagtcagtgccaaagtagtgacagaagaaatcttgagaggaagcatttttgtcttgtacttgaaacagctgctgggcccaccatggctcctgtgaagatcagccatgtggtatcattttcttctcaggatcccaagtatcctgtagagaacttgctaaacccagatagtccaaggagaccttggctcggctgccctcaggacaagagtgggcaattgaaagtagaactac

SEQ ID NO: 172560 - DNA, 580 bp, Homo sapiens
  Payload ID: 13925
  Gene Symbol:
  Gene Name: Putative short transient receptor potential channel 2-like protein  [Source:UniProtKB/Swiss-Prot
  Acc:Q6ZNB5]
  ENST ID: ENST00000534704
  CDS Start-End: 334-580
tccgaggcaacggtggctcctcgaggtccacggtcccggagatgggatttcgccatgttgcccaggctgatcttgaactcctgggctgaagatatccaccctcctcggcctcccaatgtgctgggattacaggcctgagccaccatgcctggcccaagtgttcattgatgatgagagatgggcttttcgcatcaaatcacaaaaatatgctgagtaatgtgaggattcttgcttttctggaagctaacacatagtcagtgccaaagtagtgacagaagaaatcttgagaggaagcatttttgtcttgtacttgaaacagctgctgggcccaccatggctcctgtgaagatcagccatgtggtatcattttcttctcaggatcccaagtatcctgtagagaacttgctaaacccagatagtccaaggagaccttggctcggctgccctcaggacaagagtgggcaattgaaagtagaactacagctggagagggcagtgcccactggctacattgatgtgggtaactgtggctgtgcgttcctgcaaattgatgtgggccattcttcctggcccctggaca

SEQ ID NO: 172561 - DNA, 754 bp, Homo sapiens
  Payload ID: 13925
  Gene Symbol:
  Gene Name: Putative short transient receptor potential channel 2-like protein  [Source:UniProtKB/Swiss-Prot
  Acc:Q6ZNB5]
  ENST ID: ENST00000532852
  CDS Start-End: 1-426
caggacaagagtgggcaattgaaagtagaactacagctggagagggcagtgcccactggctacattgatgtgggtaactgtggctgtgcgttcctgcaaattgatgtgggccattcttcctggcccctggacagacctttcataaccctgctccctgcaaccacgctaatgtctctaactgattcaaagcaggggaagaaccgctccggggtccgcatgtttaaagatgttgatttcctggctccagcctcaggagagttatgggatcgacttcgcctgacctgctcccgacccttcacgcgtcatcagtcctttggcctggcctttctacgggtgtgttcttctctggactccttagatgactctgtggtgggtccctcagcccttctgagctctgtgctgaacaaggtgggagaaatgttttagaggcaagagaggctgctaaacatcctacaatataaaggaaacatccccacagcaaaaaaaaaaaactgttcttctcaaaatgttgacagtgctggagatcagacacattgctctactttatattttattgtctgtccctgaacttctttattaaatggccaatattgtatggtaaaatcgagagtatcatcagaaagaaaattaagaaaaacaatcagaattagaaattagaggctcctctgcctatggaatagccattcttttattcctttgctttcttaataaactttgtctcacttaaaaataaaaagaaattagattttctgga

SEQ ID NO: 172562 - DNA, 1026 bp, Homo sapiens
  Payload ID: 13926
  Gene Symbol:
  Gene Name: Putative UPF0607 protein ENSP00000381418  [Source:UniProtKB/Swiss-Prot
  Acc:A8MU76]
  Uniprot ID: A8MU76
  ENST ID: ENST00000614215
  CDS Start-End: 1-1026
atgaggctgtgtcttagccctcagaacacgggcaccccacagagggtcctgcctcctgtggtctggagccccccctcgaggaagaaacctgcgctgtctgctcgcaactccacgatgtttggacacctcaggcccctgaggatccctcgtctcagaggcaagtttaaccttcaacttccttcatttgatgagcaggtgatcccagccaggctcccgaagacggagatgagggcagaagagcccaaagaagcaacggaggtgaaagaccaggtagagacccaggggcaggaggacaataaaaggggcccctgtagcaatggggaagcggcctccacctctaggcccctggagactcagggaaacctcacttcctcctggtacaatcccaggaccttggagggaaatgtccacctcaagagcttgacagaaaacaaccagactgacaaggcccaggtgcatgcagtgagtttctactccaagggccatggagtcgccagttcacacagccctgctggaggcatccttccctttgggaagcctgacccacttccaacagtgctccctgccccagttccgggctgctccctgtggccagagaagggggccttgaaggtgctgggtaaagaccacctgcccagctctccaggcttgctgatggtgggggaggacatgcagcccaaggatcctgcagctcttggatcaagtaggtcttctccacccagagctgccggccacagttcccgcaaaagaaaactgtcggggccactgctgcagctgcaactgacccctcccctgcaactgaggtgggatagagacgaggggcccccaccggctaagcttccatgtctatctcctgaggcactgttggtgggtcaggcttcccaaagagaaggacgcctccagcagggcaacatgcataagaacatgagggtgctaagtagaacatcaaaattcaggagactaagagagctgcttaggaggagaaaggagagacggcagggcaggcgtggtggcccacgcctgtaa

SEQ ID NO: 172563 - DNA, 2621 bp, Homo sapiens
  Payload ID: 13927
  Gene Symbol: PWP1
  Gene Name: PWP1 homolog, endonuclein
  Uniprot ID: Q13610
  ENST ID: ENST00000412830
  CDS Start-End: 169-1674
agaatgacgtctgaaatgagcgccgacgctgcccaaacaggagcctgcgcatgcgctctgccctggcagcggccctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgtaaggctcttgttgcatttcttaaaaaagagtaataaaaaggatttttaaaaagtaattccttaaacataccatctgtcacagttaatctagatttgtaaataggtagtaatttatagaatttttaaagcgtaaaatccggtaatattaaaagataggtaaacctaggcctggaaaggctgttatttggctaaaattgcacaggaggccatgaacagaggcaagtgccccagagactccactttcattcctaactgttctcaaattaatgctcatgattgagtattctcagtgcaactcgtagagtttgataagtaaaagttacatgcccctgttttcctagcatgatattcactgttatcaaagacaagaggcagaccattcattcattctcaaaacactgaatgccattctgtgcctagtgctatacaaggcatgggagattcagtgtgaataagtctttgctctccacctaacaagggacagttttaattatagattgtcttcctattaagtatgagttttagtaggcattaaaaatcgtaattagtttgataatatgagacccaaccctaacttgccagaagagtaatcagttcatgaaccattgatatttcctgtatatttcatgaatgtgacttcagtcattctagtgttaatactgtggaatgtcattggtgtagcaacgtgggttcaccaaaacacctttttatacaaaagacagatgtgtgaattaaagagattaaaggatagagta

SEQ ID NO: 172564 - DNA, 1722 bp, Homo sapiens
  Payload ID: 13927
  Gene Symbol: PWP1
  Gene Name: PWP1 homolog, endonuclein
  ENST ID: ENST00000541166
  CDS Start-End: 211-1530
aacgtggacccggaactcggggcgttggctggtgcgactggctggggtgagggcggctttgcccggattgtcgcgactagagctgcagttcagaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaagaaaaagaaaggaaagaagagttcctcagcagaagggcataccgatgctgtccttgacctttcatggaataagctaatcagaaatgttttagcaagtgcatcagctgacaacactgtaattctgtgggatatgtccttggggaaaccagcagctagcctcgctgtacacacagacaaggtccaaacactgcagtttcatccatttgaagcacagactctgatttctggctcatatgataagtcagtggctttgtatgactgccgaagtccagatgaaagccatcgaatgtggcgattcagtgggcagatagagagagtgacttggaatcacttttcaccttgtcatttcttggccagtacagatgacggctttgtatataatttggatgcacgttcagataagccaatttttacacttaatgcacacaatgatgaaatctctggtcttgatcttagcagtcaaatcaagggctgtctcgtgactgcttcagctgacaaatacgtgaagatctgggacatcttaggagataggccaagtctagttcattctagggacatgaaaatgggagttctcttctgttcttcatgttgccctgatttgccatttatttatgcctttggaggtcaaaaagaagggcttcgggtctgggatataagcacagtctcttcagtaaatgaagcatttggaagacgagagaggcttgttcttgggagtgcaagaaattcatctattagtggcccttttggcagcaggagctcagatacacccatggagtcttaatgaagatcatctaatttcctgcttaccttaactgggaattttaaaaagttggcctaaaaatgttccatgcgtggcagcaaccatgcagagtgactgaaacacaattcatttctgactgacattcctttctgcaactgcggtggcaccacaaatatccggtctttgtgcttgctcttcagatggatggtttgt

SEQ ID NO: 172565 - DNA, 569 bp, Homo sapiens
  Payload ID: 13927
  Gene Symbol: PWP1
  Gene Name: PWP1 homolog, endonuclein
  ENST ID: ENST00000547995
  CDS Start-End: 275-569
gtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacagaacaatatgaacgtgaagatttcttgattaagcccagtgataatcttatagtttgtggccgagctgaacaggacc

SEQ ID NO: 172566 - DNA, 851 bp, Homo sapiens
  Payload ID: 13927
  Gene Symbol: PWP1
  Gene Name: PWP1 homolog, endonuclein
  Uniprot ID: Q13610
  ENST ID: ENST00000552760
  CDS Start-End: 99-542
ggccctgtgcagatccctgagcgtgtggcagcagtgcggtcgtggtccctccctatgcagcctggtttctagcgtgacacgcccttgacttgaggaccatgaaccgcagccgccaggtgacgtgcgtggcctgggtccgctgcggcgtggccaaagagacaccagacaaggtagagctgagtaaagaagaagtaaaacgcctcattgctgaggcaaaggagaaattgcaagaagaaggtggtggcagtgatgaagaggagacaggcagtccttcagaagatggcatgcagagtgcacgcacccaggcacgcccaagagagcccctggaggatggtgacccagaggatgacaggacgcttgatgatgatgagctggctgagtacgacttagataaatatgatgaggaaggtgacccagatgctgagactcttggtgaatctctcttgggtcttacggtctacgggagtaatgatcaagatccttacgttactctgaaagatacatcaatgacatttttttcctctcacttaggaacaatatgaacgtgaagatttcttgattaagcccagtgataatcttatagtttgtggccgagctgaacaggaccagtgcaatttagaggtgcatgtttataatcaagaagaagactctttttatgtacaccatgatatactcttgtctgcatatcctctgagtgtggaatggctgaattttgatcctagcccagatgattctactggaaattacattgctgtaggaaacatgacccctgttattgaagtgtgggaccttgatatagtggactctttagagccagtcttcacactcggaagtaaactttcaaaaaagaa

SEQ ID NO: 172567 - DNA, 3297 bp, Homo sapiens
  Payload ID: 13928
  Gene Symbol: PWP2
  Gene Name: PWP2 periodic tryptophan protein homolog (yeast)
  Uniprot ID: Q15269
  ENST ID: ENST00000291576
  CDS Start-End: 128-2887
gcgctgtgggcggtgcacgccgtcgcttcccggaagtgcgtgctgtgggcggtgccgcgcggacccccgggaagtgtctctgtgggcggccgccgggttgagctgcggcacacgtgcgacggccgtgatgaagttcgcttaccggttttcaaatttgctgggtacggtgtaccggcgtgggaacctaaattttacctgcgatggaaattcagttatcagtcccgtgggcaatagagtcactgtatttgaccttaaaaacaacaaatctgacacgctgcccctggccactcggtacaacgtcaagtgcgtggggctgtccccggatggccgcctcgctatcatcgtcgatgaagggggcgatgcgctgctggtcagcctggtctgcaggtctgtgctgcaccacttccacttcaagggctctgtgcacagtgtgtccttctcccctgatggcaggaagtttgttgtcacaaagggtaacattgcccagatgtatcatgcccctgggaagaagcgggagttcaacgccttcgttctggacaagacctattttgggccctacgatgagaccacctgcatcgactggacggatgactccaggtgctttgtggttgggagcaaagacatgtccacctgggtgttcggagccgagcgctgggacaacctcatctactatgcactggggggacataaggatgccatcgtggcctgcttctttgaatccaacagcctggacctgtactcactcagccaggacggagtgctgtgcatgtggcagtgtgacacgccccccgagggcttgcggctgaagccccctgcgggctggaaagcagacctgttgcagcgggaggaggaagaggaggaggaggaggaccaggagggcgacagagagaccaccatccggggaaaagccactccggccgaggaggagaagacaggaaaagtgaagtactcacggctggccaagtacttcttcaataaagaaggggattttaacaacctgacagctgcagcatttcataagaagtctcacctcttggtcactggctttgcttctggaatcttccatcttcatgagctgccagagtttaacctcatccactccctgagcatttcagatcagagcatcgcctcagtggccatcaatagctcgggggactggattgcttttggctgttcaggcctgggccagctgctggtgtgggagtggcagagtgagtcctacgtgctcaagcagcagggccacttcaacagcatggtggccctggcctactcgcccgacggacagtacatcgtgactggcggggacgacggcaaggtcaaggtgtggaacaccctcagcggcttctgcttcgtcacttttacggagcactccagcggggtgaccggtgtgacctttactgccaccggctacgttgtggtgacctcatccatggacgggaccgtgcgagcctttgaccttcacaggtaccgaaacttccgcaccttcacctctccacgccccacccagttctcctgtgtggcggtggatgcgagcggtgagatcgtctctgcaggggcgcaggactcctttgagattttcgtgtggtccatgcagacaggcaggctccttgatgttttgtctggacacgaagggcccatcagtggtctgtgttttaacccaatgaagtccgtcctggccagtgcctcctgggacaagacagtgcgcctatgggacatgtttgacagctggaggaccaaggagacgctggccctgacctctgatgctctggctgtgacttttcgccctgatggtgcggagctggctgtggccacactgaactcacagatcaccttctgggaccctgagaacgcggtgcagacgggctccattgagggcaggcatgacctcaagactggcaggaaggagctggacaagattacagccaagcacgcggccaaggggaaggccttcaccgccctgtgctactctgcagacggccacagcatcctggcgggaggcatgtccaagttcgtgtgcatctaccacgtccgtgagcagattctcatgaagaggttcgagatctcttgcaacctgtctttggacgccatggaggaatttttgaaccgaagaaaaatgacagagtttggcaacctggcactaattgatcaggatgctgggcaggaggatggagtcgcgataccactgccaggcgtcaggaaaggtgacatgagttctcggcacttcaaacctgagatcagggtgacctcactccgcttctctcccactgggcgctgctgggcggccaccaccacggagggactcctcatctactccctggacacccgcgtgctctttgacccgtttgagctggacaccagcgtcacccccgggagggtgcgcgaggcactgcgccagcaggacttcaccagggccatcctcatggccctccggctcaacgagagcaaactggtgcaggaggccctggaggcggtgcccaggggcgagattgaagtggtcacctcctcccttcctgaactgtatgtggagaaagtgctggagtttttagcttcctcctttgaagtgtctcgccacctggaattctacctcctctggactcacaaactgctcatgttgcacggacagaagctgaagtccagagccgggacgctgctgcctgtcattcagttcctccagaagagcatccagcggcacctggacgacctgtcgaaactctgtagctggaaccactataacatgcagtacgcactagcagtttccaagcagcggggcacaaaacgctccctagacccgctgggaagtgaggaggaggcagaagcatctgaagatgacagcctgcatctgcttggaggaggaggcagagactcagaagaagagatgctggcctagagccagccggttgcagcgttggattgtgccggctaagacctgccagggagatgggacccttgtgccacctgggccagcaaagaggaggggtccagagaacagctgaaatactgtcactagtggtagtgacttgcttttcctgtgcacacatgtagcccatcaggacagcgagccgacgggtcacgccaggggccggcacgcactggcacctggccccaggagcggggccgtgtgaacggtgatgaatgttgaaaatgcgtctcagagaggtattcacatgaactttgtatgagacttatttatatctttaacataaaggtttgataaagaacttagggattaaaaaaaagatggagttttctaacgtgaggatgaagtctacacttcagattaaaaagggttatgttgta

SEQ ID NO: 172568 - DNA, 604 bp, Homo sapiens
  Payload ID: 13928
  Gene Symbol: PWP2
  Gene Name: PWP2 periodic tryptophan protein homolog (yeast)
  ENST ID: ENST00000456705
  CDS Start-End: 45-604
gggcggccgccgggttgagctgcggcacacgtgcgacggccgtgatgaagttcgcttaccggttttcaaatttgctgggtacggtgtaccggcgtgggaacctaaattttacctgcgatggaaattcagttatcagtcccgtgggcaatagagtcactgtatttgaccttaaaaacaacaaatctgacacgctgcccctggccactcggtacaacgtcaagtgcgtggggctgtccccggatggccgcctcgctatcatcgtcgatgaaggaagtttgttgtcacaaagggtaacattgcccagatgtatcatgcccctgggaagaagcgggagttcaacgccttcgttctggacaagacctattttgggccctacgatgagaccacctgcatcgactggacggatgactccaggtgctttgtggttgggagcaaagacatgtccacctgggtgttcggagccgagcgctgggacaacctcatctactatgcactggggggacataaggatgccatcgtggcctgcttctttgaatccaacagcctggacctgtactcactcagccaggacggagtgctgtgcatgtggcagtgtgacacgccc

SEQ ID NO: 172569 - DNA, 3346 bp, Homo sapiens
  Payload ID: 13929
  Gene Symbol: PWWP2A
  Gene Name: PWWP domain containing 2A
  Uniprot ID: Q96N64
  ENST ID: ENST00000307063
  CDS Start-End: 36-2303
agccggagttggaggagggagaagctaggaagaaaatggcggccgtggctgcagaggcggcagcgactgcagcgtcccccggggaggggggcgccggcgaggccgagccggagatggagcccatccccggcagtgaggccggcactgaccccctcccggtcacggccactgaagcgtctgtgccggatggcgagactgacgggcagcaatccgctcctcaggccgacgagccgccgctcccgccgccaccgccgccgccgggggagctcgcccgcagcccagaggcggtggggccggagctggaggctgaggagaaactgtccgttcgggtggcggagtcggcggcagccgcgcctcagggagggccggaacttccaccttctcctgcatcgccgccggagcagcccccggctcccgaggagcgcgaggagccgccgctgcctcagcccgtagccccggcgctcgtgccgccggcgggcggggactccacggtgtcgcaactgatcccgggctcggaggtgcgggtcacgctggaccacatcattgaggacgcgcttgtcgtgtcgttccgcttcggggagaagctcttctccggggtcctcatggatctgtccaaaaggtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcaggtgaggccccttcagaaaatcagagtccctcaaaaggccctgaagaggccagcagtgaggttcaggacacaaatgaagtgcatgtgcctggtgatcaggatgaaccacagacattgggcaaaaagggcagcaaaaacaatatctctgtttatatgaccctaaatcaaaagaaatctgactcttccagtgcttcagtgtgtagcattgatagcacagatgatttgaaatcttccaactctgagtgtagttcttctgaaagctttgattttcctccaggcagtatgcatgcaccttccacctcctccacttcctcctcttcaaaggaagagaaaaagctcagtaattccttgaaaatgaaagtcttttccaaaaacgtctctaaatgcgtcacaccagatggcaggaccatatgtgtaggggacattgtttgggccaagatatatggcttcccttggtggccagcccgtattcttactataactgtgagccggaaagataacggccttttagtccgacaggaggcccgtatttcatggtttgggtctccaacaacatctttccttgctctttcacaactctccccctttttagaaaacttccagtcacgctttaataagaagagaaagggcctgtatcgcaaggctatcacagaggcagctaaggctgccaagcagctgacccccgaagtgcgggctttgttgacacagtttgaaacgtgaacatgggcagtaaggtaggcaagaccattggaagtcaccacagattttctagtctagttaggaataatttctacaaaatagcgtggccagattggagagagaagttgcactcagttggctggctttttaatacttaccttatagccatttttagactgagagcttaaactgaacatataatcaaattttgtgttaaggaagtgagattttagcagtatttttcagttttgaagttcgaaaccatcccaaggcataggagccatagcctcaactgaaattgaatttttgtagggactgttaattgccatttgtacctaatactgtatatatacatatatatacgtgtgtgtgtgtgtatatatatatatccgtgtatgtatatatacacacatatatatgtatatatacacatatatatatatgaaatacagcctgtcactgtgtgacacagattgcatatttgggattgcaataagggcttggtgagctgggggaatagtggatatttaatgactacttgttttttaaataatgaacacttagcctttctatgcgcataatggtgtaaaagttagatggttaggtgtttgacaaacagatggttgcaattcagttacagactggggaaatagcccagtgtttgggattaaaactgtcaagactggataggtgttagtcatcactgtctttcgtccagtggggatttaataaatactttcaagcttctggtttgggagtttagataggtttgattttggatttgtaaatagtgattgctaaatttggtcagatttctcctgactggctgttcctaaattcttaggatatgtcccagtaaaattatactttgtgaattaattgtcatatgtgtaattgttgcattttggatgtacctaatttgataattaaaacaaaataatttccgtttaaggtatctgtttgcaggtcagaaaatgagaaaatgtaattgtgtaatgctctgaaatgtaaaaaaaaaaaaaaaaaccaaaaaaaagctgtaaataaaatcaactaaatccaaa

SEQ ID NO: 172570 - DNA, 3991 bp, Homo sapiens
  Payload ID: 13929
  Gene Symbol: PWWP2A
  Gene Name: PWWP domain containing 2A
  Uniprot ID: Q96N64
  ENST ID: ENST00000456329
  CDS Start-End: 36-1718
agccggagttggaggagggagaagctaggaagaaaatggcggccgtggctgcagaggcggcagcgactgcagcgtcccccggggaggggggcgccggcgaggccgagccggagatggagcccatccccggcagtgaggccggcactgaccccctcccggtcacggccactgaagcgtctgtgccggatggcgagactgacgggcagcaatccgctcctcaggccgacgagccgccgctcccgccgccaccgccgccgccgggggagctcgcccgcagcccagaggcggtggggccggagctggaggctgaggagaaactgtccgttcgggtggcggagtcggcggcagccgcgcctcagggagggccggaacttccaccttctcctgcatcgccgccggagcagcccccggctcccgaggagcgcgaggagccgccgctgcctcagcccgtagccccggcgctcgtgccgccggcgggcggggactccacggtgtcgcaactgatcccgggctcggaggtgcgggtcacgctggaccacatcattgaggacgcgcttgtcgtgtcgttccgcttcggggagaagctcttctccggggtcctcatggatctgtccaaaaggtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcaggtctcaacaaatggcagctattacatcagacagtgacgagtcctgctgctcccttacagtgtctgacagaccactgtggattcagactgggagcattgaagttaacagtgaaacgggcagcacaaagacattagcaggctgctggtttcatggacctgtaccacaatgacacagagaacaccagagcatcaggactgaatgaaattggagtttttaaagctgcactaagaagtaaatgttaaggcagtggttaaaaacaacagtctataaaggggcacttgcaaattgtgctgtcttaaaccgaagaaaaggtattagggaatattttataaaaaataaacttgcaataaattatgcatgagatgaggagaaaaatgatgtgaattacacacgtaagaactcacttgaattttatatatgaagaaacactgacagtaacttctttggaatgtgaagttcttatcagtacagtttggacaggcctaaaaggcatgggatgatgcagaaatgctgaattatttttcatacttaaactttgtgctttctccaaggtttaggttaatcagttcagatatgagcaaaggtatttctaaaatggctcttctatgaaaagcaatagtcacatatgccaaggccaatgtttccttcaaggtgccagtagaaacaacagaaaataacatcctgctgaaaggatggcaaagtgccccgccccaccccacaaacacaatttggatcttttccttctttaataaagcagggctgtattatcttgaatatatgtttgcttgttagaacatattaagatatatttatttgccactagtatttaacattttgtgcacattttcataattacattcttacctttcaaattttgactcaaagtggataggctagtgttgatattggagtgcaaatgtatatactccaagagctagttcttaattctgctgagttggaaagccttttattattgtctgtatccttactggttttatctagttcaaaaaaggtgacaacgtctaaattttgatgtggacctctctccatagagagccgctcctaagtgcaagaaattccaacaggtgtcagtaggacttggccctgggggacaacaagtggcaggaacaggatcctttaaaacagtgtcaaacttctcatgcatggagcatgaattcttactaatagagactgtagtttttttcttgtctttggtaaatatataaaagaccttaatttttcttttttaatgaatggagaaaacatgagaaaaccagatggacctgttagtactacatttttaaggcattttatatttgatggtgccgtacttttaataataataaaactgaagttttttagtggcaatactgatttattttttaaaccagaaagataatccatattgattacttactacaaaaaagggaaaatatgccaaaaaataaaaaaccttaaaattcatatgaagcaacgtaacagataactgagcacttggctcaagtggtcagacttttcataatgttactgtgtaagtttggaattacctaataaccccaggctcaggattaacagaaggttctgggtgagttttaaaacatttaatatacctatgatttgttttacaacttgaagaaaaggcaggcagtcttgtgtctaatgagcttaatgcaaattctaattatactgcaaataatttaaagttttgattgcattctacaattgtctgtttggaaaattacatattatgaagtcattatatattttatcaaatcagaaaaagtcagctcaggaactgtagcagcagggagttctaaagatgacatgaactatactataggggtgccctactctatatggcctagggctttggtttgggtcagtcttgttctttcagatacataacaccagcagtactttcgggctcacttcaagaaccagataactctcccaaaccatgatacatgaagtgtataatcaagatttttaattaagctttagaattctttatttgtgtagagtgatggaaatgaccaagaagtaataatataaagcaaaagaattgggagagatcaggttttaagtatataaatattttttttttctcatggcatattctcaaaggtgttttgttacaaaccagattttcattttttaaaaaatgagacttggtggtatttaaaacctacacctaccatgttgctatttcactttcattgctttagttgcttaatatttaagctttgcttcatgctaccttttgtctgtatttcaatcttcataagcctattttgttttgtagacttgaatgataaaaattgtttctcatcttaagtatgctcagagttttaaatgttaaagaatgttgtgtaacctttatccaataaagtctttgattttttaaaaa

SEQ ID NO: 172571 - DNA, 1819 bp, Homo sapiens
  Payload ID: 13929
  Gene Symbol: PWWP2A
  Gene Name: PWWP domain containing 2A
  Uniprot ID: Q96N64
  ENST ID: ENST00000523662
  CDS Start-End: 35-1597
gccggagttggaggagggagaagctaggaagaaaatggcggccgtggctgcagaggcggcagcgactgcagcgtcccccggggaggggggcgccggcgaggccgagccggagatggagcccatccccggcagtgaggccggcactgaccccctcccggtcacggccactgaagcgtctgtgccggatggcgagactgacgggcagcaatccgctcctcaggccgacgagccgccgctcccgccgccaccgccgccgccgggggagctcgcccgcagcccagaggcggtggggccggagctggaggctgaggagaaactgtccgttcgggtggcggagtcggcggcagccgcgcctcagggagggccggaacttccaccttctcctgcatcgccgccggagcagcccccggctcccgaggagcgcgaggagccgccgctgcctcagcccgtagccccggcgctcgtgccgccggcgggcggggactccacggtgtcgcaactgatcccgggctcggaggtgcgggtcacgctggaccacatcattgaggacgcgcttgtcgtgtcgttccgcttcggggagaagctcttctccggggtcctcatggatctgtccaaaaggtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgacccaaacgaaaaatgtacagggaagaacccacttcaataatgaatgctattaaactacgacccaggcaagttctgtgtgataaatgtaaaaacagtgttgttgctgaaaaaaaggaaattagaaaaggtagtagtgcaactgactcttctaaatatgaagataaaaaacggagaaatgaaagtgtaactactgtgaacaaaaaactgaaaactgaccataaagtggatgggaaaaaccaaaatgaaagccagaaaagaaatgctgtggttaaggtttcaaatattgctcacagcagaggcagagtagtaaaagtttctgctcaggcaaatacatcaaaagctcagttaagtactaaaaaagttctccagagtaagaacatggatcatgcgaaagctcgggaagtgttaaaaattgccaaagaaaaggcacaaaagaagcaaaatgaaacctctacttccaaaaatgcacattcaaaagtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcagcacaaagacattagcaggctgctggtttcatggacctgtaccacaatgacacagagaacaccagagcatcaggactgaatgaaattggagtttttaaagctgcactaagaagtaaatgttaaggcagtggttaaaaacaacagtctataaaggggcacttgcaaattgtgctgtcttaaaccgaagaaaaggtattagggaatattttataaaaaataaacttgcaataaattatg

SEQ ID NO: 172572 - DNA, 767 bp, Homo sapiens
  Payload ID: 13929
  Gene Symbol: PWWP2A
  Gene Name: PWWP domain containing 2A
  ENST ID: ENST00000524050
  CDS Start-End: 1-106
gaagacaggacttgagaaaatgcggagtggcaagatggcacccaagccccagtctcgctgcacctctacccgctcagcagaatttatagaccaggaagctgactaatcatttggaaggaacatccattcaactctcatttacagatgtggaaccaaagaccaaacaattatctgtgagaggccagagatggaaccttgctatgttgctcaggctggtctggatctctggcctcaagcaatactcctgcgttggcctcccaaagtactgtgattacagactatgaagggctgctgaaataaaagtttgggcacggtggctcacgcctgtaatccaaagccaaggtctacttccagtggaggtgagaatgggggtggacgaaaagagaaatccctaatcaccagaggtacaggctccttcccacttcttagcagcttttctcactctgaggcctcccatcttagagtaaagcccaggggacagagtggctgcactctaaaatccatcagcacattcatgcagaggccacccttcccacctgctgcttccagccaatgcctgagcatgggagggactcgtctgaggggcagcactggctccccaatggctttgctgaaactttctcagcaccacactccagtggaaaacttccccgctcccccggcctttcctcctccacaggggtctgccaactctgccaacagcctccagctcccagccccattttcccttgcaggtgtttcccccagtaaatctcttgtacttttaa

SEQ ID NO: 172573 - DNA, 734 bp, Homo sapiens
  Payload ID: 13929
  Gene Symbol: PWWP2A
  Gene Name: PWWP domain containing 2A
  ENST ID: ENST00000521424
  CDS Start-End: 1-210
gtccatttcacacgtcgatatcagaatcctagctcaggttcccttccaccccgggttcgtttaaaaccacagaggtacaggaatgaagaaaatgactcttctctgaagacaggacttgagaaaatgcggagtggcaagatggcacccaagccccagtctcgctgcacctctacccgctcagcagaatttatagaccaggaagctgactaatcatttggaaggaacatccattcaactctcatttacagatgtggaaccaaagaccaaacaattatctgtgagaggccaggtctcaacaaatggcagctattacatcagacagtgacgagtcctgctgctcccttacagtgtctgacagaccactgtggattcagactgggagcattgaagttaacagtgaaacgggcagcacaaagacattagcaggctgctggtttcatggacctgtaccacaatgacacagagaacaccagagcatcaggactgaatgaaattggagtttttaaagctgcactaagaagtaaatgttaaggcagtggttaaaaacaacagtctataaaggggcacttgcaaattgtgctgtcttaaaccgaagaaaaggtattagggaatattttataaaaaataaacttgcaataaattatgcatgagatgaggagaaaaatgatgtgaattacacacgtaagaactcacttgaattttatatatgaagaaacactgacagtaacttcttt

SEQ ID NO: 172574 - DNA, 407 bp, Homo sapiens
  Payload ID: 13929
  Gene Symbol: PWWP2A
  Gene Name: PWWP domain containing 2A
  ENST ID: ENST00000520662
  CDS Start-End: 1-150
tccggggtcctcatggatctgtccaaaagagaccatgaaacgtatggtgcaatagccctacttttggtgggaaaaatatacagccattctggtgaagcagtttgggccccatggtatccctgtgacagtatttcccaaaagggaatataaggataaaccagaagccatgccgctccaaagtaatacattccaagaagggacagaagtcaagtgtgaagcaaatggtgctgttcccgatgacccttctcctgtcccgcatcccgagctgagcttggctgaaagcctgtggacttccaaaccaccacctctcttccatgaaggagcaccttatcctccccctttgtttatcagggacacatataaccaatcaatacctcagccacctcctcggaaaattaagcgaccca

SEQ ID NO: 172575 - DNA, 2651 bp, Homo sapiens
  Payload ID: 13930
  Gene Symbol: PWWP2B
  Gene Name: PWWP domain containing 2B
  Uniprot ID: Q6NUJ5
  ENST ID: ENST00000305233
  CDS Start-End: 60-1832
ggcggcggcggcggcggcggcggcggcggggcgggggcggcctgggacgcggcgggagcatggagccgcgcgccggctgccggctgccggtgcgggtggagcaggtcgtcaacggcgcgctggtggtcacggtgagctgcggcgagcggagcttcgcggggatcctgctggactgcacgaaaaagtccggcctctttggcctacccccgttggctccgctgccccaggtcgatgagtcccctgtcaacgacagccatggccgggctcccgaggagggggatgcagaggtgatgcagctggggtccagctccccccctcctgcccgcggggttcagccccccgagaccacccgccccgagccacccccgcccctcgtgccgccgctgcccgccggaagcctgcccccgtaccctccctacttcgaaggcgcccccttccctcacccgctgtggctccgggacacgtacaagctgtgggtgccccagccgccgcccaggaccatcaagcgcacgcggcggcgtctgtcccgcaaccgcgacccggggcgcctcatcctcagcaccatccgcctgcggccgcgccaggtgctctgtgagaagtgcaagagcacgctgagccccccggaggccagccccggacccccagccgcgcccagggcccgcaggaggctgggcagcggcccggacagggagctccgcaagccggaggagccggagaacggcgagcccacggctgcggccaccgccaggaggagcaagagggagaggcgcgaggaggacagggccccggcagagcaggtcccgcggagcccggtcatcaagatctcctacagcacgccccagggcaagggagaggtggtcaagatcccctcccgcgtgcacggctctctggagcccttccgtccccagcaggccccgcaggacgacggcagccaggaccccgaggtgctggacagagagtcccgggaccggccgtcctgcgcgccctcggcctccatccccaagttgaaactgacacggcctgtgccggccggcgcggacctgccgccccctaagatccgcctgaagccccaccgtctgggggacagcgagcacgagcccgtgtaccgggccgagctggtgggggagctgaacgggtacctgcgggacagctcgccggcgccctgtgcggacggccctgccggtgggctggcggacttgtcttctggaagttcgggtgaggacgatgacttcaagagctgtccccagggtccacagggacgcgagggcttggcttttctcgtcagctgccctgaggggagagcggactgtgccagtgagtcggcgtgcagcagcgacagcctggacgaggccagatcgtccggctcggaagggacgccggcagacacgggtgacctctcgcctggccacggcgcgtcagcgccctcggtgtccagagaggctcgccaaacggtgccgcccctgacggtcaggctgcacacacagagcgtgtcggagtgcatcacggaggacggcaggactgtggccgtgggggacatcgtctggggtaagatccatggttttccttggtggccggcgcgtgttcttgacatcagtctcggccagaaggaggacggagagccgtcttggcgagaagcgaaggtctcgtggtttggttctccgactacgtcgttcttgtctatttcaaaactctcccctttctctgaatttttcaaactgagatttaatcgtaagaagaaggggatgtatcggaaagctataaccgaggctgcaaatgccgcaagacacgtggccccggaaatcagggagctcttaacccagtttgaaacgtaactggttccctgaccaggtcaccgacgatgagggcgcacctgctgtcctggagcttccgatctctgttcggggaccctgtgagccttctggccggctgcgtgcagagcccactgggcacggtggtcggcctggtgtgaggccccccggggaccggcagtgtgtccagggaggggatggccctgagcccagcggctcctcccgctgagtgtatttcttcccaccactcagcgcatggctgccctggctcacgaggcagtcgggactcgtgacttgctggctgctggctgctgctgcctcgcgcgctggggttccatggaggaactgggcctgccgccccggcctcacctgctgcccgcatgctggggtcccatggaggaaccaggcctggcgccccggcctcgcccagcggctggtgtgggcagctgttccctgcctcgcagtgtcctggaggcagctgtctcgcagactcagcttggtctcccgcaggcttcagaaaaacccaattgcacgtgtgggattcttccccagcccttgggtgcggggtctctgtgcacttgagagctgggggacccacccaccgtctcccactccaagttcatcccagagcgtggggcccgctgggcacctggcacctggcctgcagatgctgctacgagtgaccagtgctgtgtggaggaggccaagggcggcccctgggaaaccgggcttcaacagtacaaggaaaagaaacttgctctgttttgtaagagcgtgttccttttcctcttttttgtcactttaaagaccaaaaagaataaagaaagaaaagaaaaaaattaa

SEQ ID NO: 172576 - DNA, 2013 bp, Homo sapiens
  Payload ID: 13930
  Gene Symbol: PWWP2B
  Gene Name: PWWP domain containing 2B
  Uniprot ID: Q6NUJ5
  ENST ID: ENST00000631148
  CDS Start-End: 60-1559
ggcggcggcggcggcggcggcggcggcggggcgggggcggcctgggacgcggcgggagcatggagccgcgcgccggctgccggctgccggtgcgggtggagcaggtcgtcaacggcgcgctggtggtcacggtgagctgcggcgagcggagcttcgcggggatcctgctggactgcacgaaaaagtccggcctctttggcctacccccgttggctccgctgccccaggtcgatgagtcccctgtcaacgacagccatggccgggctcccgaggagggggatgcagaggtgatgcagctggggtccagctccccccctcctgcccgcggggttcagccccccgagaccacccgccccgagccacccccgcccctcgtgccgccgctgcccgccggaagcctgcccccgtaccctccctacttcgaaggcgcccccttccctcacccgctgtggctccgggacacgtacaagctgtgggtgccccagccgccgcccaggaccatcaagcgcacgcggcggcgtctgtcccgcaaccgcgacccggggcgcctcatcctcagcaccatccgcctgcggccgcgccaggtgctctgtgagaagtgcaagagcacgctgagccccccggaggccagccccggacccccagccgcgcccagggcccgcaggaggctgggcagcggcccggacagggagctccgcaagccggaggagccggagaacggcgagcccacggctgcggccaccgccaggaggagcaagagggagaggcgcgaggaggacagggccccggcagagcaggtcccgcggagcccggtcatcaagatctcctacagcacgccccagggcaagggagaggtggtcaagatcccctcccgcgtgcacggctctctggagcccttccgtccccagcaggccccgcaggacgacggcagccaggaccccgaggtgctggacagagagtcccgggaccggccgtcctgcgcgccctcggcctccatccccaagttgaaactgacacggcctgtgccggccggcgcggacctgccgccccctaagatccgcctgaagccccaccgtctgggggacagcgagcacgagcccgtgtaccgggccgagctggtgggggagctgaacgggtacctgcgggacagctcgccggcgccctgtgcggacggccctgccggtgggctggcggacttgtcttctggaagttcgggtgaggacgatgacttcaagagctgtccccagggtccacagggacgcgagggcttggcttttctcgtcagctgccctgaggggagagcggactgtgccagtgagtcggcgtgcagcagcgacagcctggacgaggccagatcgtccggctcggaagggacgccggcagacacgggtgacctctcgcctggccacggcgcgtcagcgccctcggtgtccagagaggctcgccaaacggtgccgcccctgacggtcaggctgcacacacagagcgtgtcggagtgcatcacggaggacggcaggactgtggccgtgggggacatcgtctggggtcaccgacgatgagggcgcacctgctgtcctggagcttccgatctctgttcggggaccctgtgagccttctggccggctgcgtgcagagcccactgggcacggtggtcggcctggtgtgaggccccccggggaccggcagtgtgtccagggaggggatggccctgagcccagcggctcctcccgctgagtgtatttcttcccaccactcagcgcatggctgccctggctcacgaggcagtcgggactcgtgacttgctggctgctggctgctgctgcctcgcgcgctggggttccatggaggaactgggcctgccgccccggcctcacctgctgcccgcatgctggggtcccatggaggaaccaggcctggcgccccggcctcgcccagcggctggtgtgggcagctgttccctgcctcgcagtgtcctggaggcagctgtctcgcagactcagcttggtctcccgc

SEQ ID NO: 172577 - DNA, 1538 bp, Homo sapiens
  Payload ID: 13931
  Gene Symbol: PXDC1
  Gene Name: PX domain containing 1
  ENST ID: ENST00000380277
  CDS Start-End: 1-539
tgcaaagccgacggatagaacctgtgatgggaagacttctgctctgcgcttctcatggggagatagaaaagcacccgagccttcatgcctcgagctatggactggttgccataaaggaagcccacgacatagagaccaggcttaatgaggtggagaagctgctgaagacgatcataagcatgccctgtaaatattctagatcggaagttgtgctcaccttcttcgaaagatctcctctggatcaggtgttaaaaaatgataatgtgcataaaattcaacccagctttcaaagtccagtcaaaatatcagaaatcatgaggtccaatggattttgtttagcaaataccgaaacaatagttattgaccacagtataccaaatggaagagaccagcagctgggcgtggacccaacagagcatttatttgagaatggcagtgagtttccctcagagctggaggacggggacgacccagcagcctacgtcaccaacctgtcatattaccacctggtccccttcgagacagacatttgggactgaacctctctatcaggcctcccccgcctcagctgttcactgccagctctgatgctgtccactgtgctggcccccatggtcacagctgctgccccagctctggaactcccagacgtcccaggccccactgacgccaggaggcctgggtgtcctgcaagtggagcagcaggggctcctagtgggccaggctgaccgcagagtctccagcaagctgaggtcacagccggaggccacagggcctgtgttctgagggtcttcactccctgcttggtgcccacagggctgcgcactgccagggcagggacagttcctgtggggctcgctctcactgctactgcttcctgggaggtgcatccctcttggtgaagtggcctagtgccccccagccaccctgactccccaccattccctcccacggcaaacgcacaaaacgtcttgagggagattttgacaagtcacccattccaggtgccacaggcaggggatgtttagtaatccaggatttctctgagaactgggatatgtggcctttttttttttctttttatcttttatctggaaactgggtttgggtcaaccccaggagtatttgcagaaggcccagcacagtggggggtattggctgcagggcagggaaggcattgccgactagataaccgtgtgagcttggactgagcgttggtggttcttcccaaaggaaaggaatttcttcccggcctgccaggtctctgggccttcagcgcgggtcctggtgctgcggccacaccaccctggggtgctcattgacagagctgccataatgaacttgaaaggacgggaatcacgagggaagctggggctcccctgcccacaggagaggatccccgttcttcaagcttctctgctcagtgtctactaacgaccgacatttgctaatgtaaataatagtaaattattgagaattctaattcttttacacagtctgtttttaatctattttaattaaataaaatctatgactct

SEQ ID NO: 172578 - DNA, 2190 bp, Homo sapiens
  Payload ID: 13931
  Gene Symbol: PXDC1
  Gene Name: PX domain containing 1
  Uniprot ID: Q5TGL8
  ENST ID: ENST00000380283
  CDS Start-End: 496-1191
ttcccggctggtccagtcaccgacctgcggctccggggccgcgagggaggaggcgcggggggcgcgaggcgggggcgagcgcttgggactcggcccggctcccggctccgggggttctcgtggccgcggcagcgcggtctctgcggaggcggcgggggcgcggccagccggacctcttcctttccagagcggcccgcggcgcccgttccgcgggaggcgggcgggaggcggacgcggcctaacctcgacgtcgactaccgcgccgcccgcgatgggaagcgccttataaagccgcgcccggccggcccgagccactcgccgccgcgccgccccgctgccccgaacgcgggccatacgcagcctccttggagtgacgggccgaccccggacgaccccggccacggacagacccgggacgaccccggccggggcgcgcctcctgcgggcgggcgggcggcggggctggggagcccttggcgggggcatgcgtgcgacatggcctcggcggtgtttgagggcacgtcgctcgtgaacatgttcgtgcgcggctgctgggtgaacggcatccgcaggctcatcgtcagccggcgcggcgacgaagaggagttcttcgagatccgcacggagtggtcggaccgcagcgtgctctacctgcaccgcagcctggcggacctgggccgcctgtggcagcgcctgcgcgacgcctttcccgaggaccggtccgaactggcgcaggggccgctgcggcaaggactggttgccataaaggaagcccacgacatagagaccaggcttaatgaggtggagaagctgctgaagacgatcataagcatgccctgtaaatattctagatcggaagttgtgctcaccttcttcgaaagatctcctctggatcaggtgttaaaaaatgataatgtgcataaaattcaacccagctttcaaagtccagtcaaaatatcagaaatcatgaggtccaatggattttgtttagcaaataccgaaacaatagttattgaccacagtataccaaatggaagagaccagcagctgggcgtggacccaacagagcatttatttgagaatggcagtgagtttccctcagagctggaggacggggacgacccagcagcctacgtcaccaacctgtcatattaccacctggtccccttcgagacagacatttgggactgaacctctctatcaggcctcccccgcctcagctgttcactgccagctctgatgctgtccactgtgctggcccccatggtcacagctgctgccccagctctggaactcccagacgtcccaggccccactgacgccaggaggcctgggtgtcctgcaagtggagcagcaggggctcctagtgggccaggctgaccgcagagtctccagcaagctgaggtcacagccggaggccacagggcctgtgttctgagggtcttcactccctgcttggtgcccacagggctgcgcactgccagggcagggacagttcctgtggggctcgctctcactgctactgcttcctgggaggtgcatccctcttggtgaagtggcctagtgccccccagccaccctgactccccaccattccctcccacggcaaacgcacaaaacgtcttgagggagattttgacaagtcacccattccaggtgccacaggcaggggatgtttagtaatccaggatttctctgagaactgggatatgtggcctttttttttttctttttatcttttatctggaaactgggtttgggtcaaccccaggagtatttgcagaaggcccagcacagtggggggtattggctgcagggcagggaaggcattgccgactagataaccgtgtgagcttggactgagcgttggtggttcttcccaaaggaaaggaatttcttcccggcctgccaggtctctgggccttcagcgcgggtcctggtgctgcggccacaccaccctggggtgctcattgacagagctgccataatgaacttgaaaggacgggaatcacgagggaagctggggctcccctgcccacaggagaggatccccgttcttcaagcttctctgctcagtgtctactaacgaccgacatttgctaatgtaaataatagtaaattattgagaattctaattcttttacacagtctgtttttaatctattttaattaaataaaatctatgactct

SEQ ID NO: 172579 - DNA, 1974 bp, Homo sapiens
  Payload ID: 13932
  Gene Symbol: PXK
  Gene Name: PX domain containing serine/threonine kinase
  ENST ID: ENST00000302779
  CDS Start-End: 110-1783
ggggcggcgcgtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcat

SEQ ID NO: 172580 - DNA, 2037 bp, Homo sapiens
  Payload ID: 13932
  Gene Symbol: PXK
  Gene Name: PX domain containing serine/threonine kinase
  Uniprot ID: Q7Z7A4
  ENST ID: ENST00000356151
  CDS Start-End: 110-1846
ggggcggcgcgtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcat

SEQ ID NO: 172581 - DNA, 1756 bp, Homo sapiens
  Payload ID: 13932
  Gene Symbol: PXK
  Gene Name: PX domain containing serine/threonine kinase
  ENST ID: ENST00000383715
  CDS Start-End: 87-1583
cggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacgattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttgaacgtgaattttcggtaaagtaaactatgctgatttctcagactttaaagatgctctgtttctgtgtgtgaaataggacccaaagtgtctcgattgctgaagtgatgaacaagtgggaaagcagatttgagactatttccttatctgaatatttaaatgaaatacagcatcttt

SEQ ID NO: 172582 - DNA, 3035 bp, Homo sapiens
  Payload ID: 13932
  Gene Symbol: PXK
  Gene Name: PX domain containing serine/threonine kinase
  Uniprot ID: Q7Z7A4
  ENST ID: ENST00000383716
  CDS Start-End: 100-1647
gtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttgaacgtgaattttcgggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcaggtcattgttacaacagaagtaaatttggcatctatagaaatcaattatgatttttgaaagatttatctaaatatatcaatatagcatctctttaatgttagtcatttattagaaagatcctttatcctgatttgcttaaacctttcaataaattgcactttaaaggattataaataatccatttaaaaattcaagtacacacatcagtgttggttactatgcagagaatgtcattgtgtatagtttcatgtaatctgttatgtcagctgtattttttattaaaatcatgtcaagaaaacgtgttgtctgtagcttgacaagatatttcaaatgagaactttttgtagcgtctgttgttagcaaagaatagattcacacagtctaaggtttccttcctacct

SEQ ID NO: 172583 - DNA, 1653 bp, Homo sapiens
  Payload ID: 13932
  Gene Symbol: PXK
  Gene Name: PX domain containing serine/threonine kinase
  ENST ID: ENST00000468776
  CDS Start-End: 105-275
ggcgcgtgttgacagcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagcca

SEQ ID NO: 172584 - DNA, 2825 bp, Homo sapiens
  Payload ID: 13932
  Gene Symbol: PXK
  Gene Name: PX domain containing serine/threonine kinase
  ENST ID: ENST00000463280
  CDS Start-End: 92-1540
agcggcggcggtggaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacgattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttgaacgtgaattttcgggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcaggtcattgttacaacagaagtaaatttggcatctatagaaatcaattatgatttttgaaagatttatctaaatatatcaatatagcatctctttaatgttagtcatttattagaaagatcctttatcctgatttgcttaaacctttcaataaattgcactttaaaggattataaataatccatttaaaaattcaagtacacacatcagtgttggttactatgcagagaatgtcattgtgtatagtttcatgtaatctgttatgtcagctgtattttttattaaaatcatgtcaagaaaa

SEQ ID NO: 172585 - DNA, 2031 bp, Homo sapiens
  Payload ID: 13932
  Gene Symbol: PXK
  Gene Name: PX domain containing serine/threonine kinase
  Uniprot ID: Q7Z7A4
  ENST ID: ENST00000484288
  CDS Start-End: 79-1626
gaaccgggcgggcggcgggagtcggcgcctcgggttcctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagtagagcatgcaccattttgaacgtgaattttcggtaaagtaaactatgctgatttctcagactttaaagatgctctgtttctgtgtgtgaaataggacccaaagtgtctcgattgctgaagtgatgaacaagtgggaaagcagatttgagactatttccttatctgaatatttaaatgaaatacagcatctttaaaaagcacccagtgacttcatctatattcatttcattttcatcatgaccttcaaaatcttcattttcactctgatttcagttttaaaatacagctctaaaacctgcaaatcaactgcatggcattttggtatattttaattttggaaaccataactctcaaagtcccgttgctgcaaaaatgttgattcctagttactctgatgaagaggaaagagtgttaggcacttgag

SEQ ID NO: 172586 - DNA, 1852 bp, Homo sapiens
  Payload ID: 13932
  Gene Symbol: PXK
  Gene Name: PX domain containing serine/threonine kinase
  ENST ID: ENST00000479134
  CDS Start-End: 1-938
catttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcaggtcattgttacaacagaagtaaatttggcatctatagaaatcaattatgatttttgaaagatttatctaaatatatcaatatagcatctctttaatgttagtcatttattagaaagatcctttatcctgatttgcttaaacctttcaat

SEQ ID NO: 172587 - DNA, 437 bp, Homo sapiens
  Payload ID: 13932
  Gene Symbol: PXK
  Gene Name: PX domain containing serine/threonine kinase
  ENST ID: ENST00000495557
  CDS Start-End: 1-257
gactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcaggatctggggccagctcacctctcacgtccccgtcatcgccaactccaccctctacatcagagcatgcaccattttgaacgtgaattttcggtaaagtaaactatgctgatttctcagactttaaagatgctctgtttctgtgtgtgaaataggacccaaagtgtctcgattgctgaagtgatgaacaagtgggaaagcagatttgagactatttccttatctgaatatttaaatgaaatacagcatctttaaaaagc

SEQ ID NO: 172588 - DNA, 583 bp, Homo sapiens
  Payload ID: 13932
  Gene Symbol: PXK
  Gene Name: PX domain containing serine/threonine kinase
  ENST ID: ENST00000491164
  CDS Start-End: 245-583
accgcagctcccggcgccgcggggtggaaggagctcggcggcgaccaggaaagcgactccgagttggggggcgggggcgggggctgcgggattcccgggctcaccttggactaggggagcaggaacgagaccgctcaggaccatccacttctgcccgccgccagccttttcctttttgaggccgtgtaatttcctccttgcagctgagggtctgggtgatggggatgagggtgtgccgggccaaatgaagtgtgactccagagcctacttgttgggacagcagagtgtaagtggctggggtctgcagccccgtttccaggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaac

SEQ ID NO: 172589 - DNA, 590 bp, Homo sapiens
  Payload ID: 13932
  Gene Symbol: PXK
  Gene Name: PX domain containing serine/threonine kinase
  ENST ID: ENST00000493474
  CDS Start-End: 1-153
aagaagtcaaaacgatctgctcttgaaaatagtgaagagcattcagcgaagtacagcaactccaataattcaggatctggggccagctcacctctcacgtccccgtcatcgccaactccaccctctacatcagtagagcatgcaccattttgaacgtgaattttcgggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctt

SEQ ID NO: 172590 - DNA, 2817 bp, Homo sapiens
  Payload ID: 13932
  Gene Symbol: PXK
  Gene Name: PX domain containing serine/threonine kinase
  ENST ID: ENST00000479241
  CDS Start-End: 42-1733
ctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacgattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgagattgccttgcaacaggtttccatgttcttccgatcagaaccaaagtgggaggtggtggaacctttgaaagacataggttggagaataaggaagaaatatttcttgatgaagattaaaaatcagccaaaggaacggctagtgttaagctgggctgaccttggcccagacaagtatttgtcagataaagattttcagtgtctaatcaaacttctgccttcttgtttgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcaggatctggggccagctcacctctcacgtccccgtcatcgccaactccaccctctacatcagctgccttaggtttgagtaaaagatgtaaagaaagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagccagtacagccacaaacagtactattttgcagatgctcatgtaagcagcttttcgagagaaataattctttaagcagaataaagttaggctggcattgctcccttaagatcttgctcctttattaaccctgtaaaggagtcttgtttatcctctaatggccaggcttttgggacagcagcatattgaaatattttcaccaactaaaggaaatagacagaaaaacaatgacaatattcaatcacagcagtaaatggcctttgtgttgcaatcccttctaccccatcagacagctcctagaaacattcctcttacagttcatttctctaaagcattttctgattcttagataactccaatttttgctacctttatcttagacattaacactatagcccaaagcatagttactttgctaaatcagaaagcaactgagttctttgttttctcctcaaatagaatggggaacgttcacaacattctcttaagttctaacaggaataccattgtggttatagaactcagggctgctaaagcaactactctagacccatagttctttttagttagatgtattgaaacagacaaaaatattaacatcagaaaaagctcttgccaattagaggatcttcttaatcctcagcaattaagtttggggtttgaggggggcaggtcattgttacaacagaagtaaatttggcatctatagaaatcaattatgatttttgaaagatttatctaaatatatcaatatagcatctctttaatgttagtcatttattagaaagatcctttatcctgatttgcttaaacctttcaataaattgcactttaaaggattataaataatccatttaaaaattcaagtacacacatcagtgttggttactatgcagagaatgtcattgtgtatagtttcatgtaatctgttatgtcagctgtattttttattaaaatcatgtcaag

SEQ ID NO: 172591 - DNA, 1610 bp, Homo sapiens
  Payload ID: 13932
  Gene Symbol: PXK
  Gene Name: PX domain containing serine/threonine kinase
  ENST ID: ENST00000477308
  CDS Start-End: 3-428
ggatggccttcatggagaagccgccagccggcaaggtgctgctggacgacacggtgccgctgacagcagccatcgaggcgagccagagcctgcagtcccacacggaatatattattcgagtgcaaagaggaatttctgtggaaaacagctggcagattgttagaagatacagtgactttgatttgcttaacaacagcttacagattgcaggcctaagtctacctcttcctcccaaaaaattgattggtaacatggatcgtgaattcatagctgaaaggcagaaaggtcttcagaactatctcaacgtgatcacaacaaatcatatcttgtctaattgtgagctggttaagaagtttttagatccaaacaactattccgcaaactatactgcacccttacatctatcgggttacctttgccacagctaatgaatcctcagcgttgctaattaggatgtttaacgaaaagggaacattgaaggatctgatctacaaggcaaaaccaaaagacccatttctaaagaagtactgcaaccctaagaagattcagggcctggaactccagcaaataaaaacatatggacggcaaatattagaggtactgaagtttcttcatgacaagggattcccttatgggcatcttcacgcctccaatgtgatgctcgatggggacacttgccggctgctggaccttgagaattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcagggatatctgcattacctccacctcctccacctccaccaccaccagcagctcccttgcctcctgcgagcaccgaggcacctgcccagctctcgtctcaggctgtgaatggcatgagccgaggggccttgctcagctccatccagaatttccaaaaaggaactttgaggaaagccaaaacctgtgatcacagtgctccgaagatcggctgaagcttcctgtttacacttggagggaaaagttcttttttattcctactcacccctaccccccaaactaccctcttcctgggaaagtaattgctgagcca

SEQ ID NO: 172592 - DNA, 2171 bp, Homo sapiens
  Payload ID: 13932
  Gene Symbol: PXK
  Gene Name: PX domain containing serine/threonine kinase
  ENST ID: ENST00000459676
  CDS Start-End: 1-612
aattccttattgggcctgccttccttctaccgatcttatttttcacaattcaggaaaatcaatacattggaaagtgtggatgtccactgctttggccacttactgtatgaaatgacttatggacgaccgccagactcggtgcctgtggactccttccctcctgccccgtccatggctgtggtggccgtgttggagtctacgctgtcttgtgaagcctgtaaaaatggcatgcctaccatctcccggctcttacagatgccattattcagcgatgttttactaaccacttctgaaaaaccacagtttaagatccctacaaagttaaaagaggcattgagaattgccaaagaatgtatagagaagagactaattgaggaacagaaacagattcaccagcatcgaagactgacaagagctcagtcccaccatggatctgaggaggaaagaaaaaaaagaaagattttagctcgaaagaagtcaaaacgatctgctcttgaaaatagtgaagagcattcagcgaagtacagcaactccaataattcagcaggatctggggccagctcacctctcacgtccccgtcatcgccaactccaccctctacatcaggttagtgatggagtaaagtgacatgccaccttcctgtccgccaacaggaggagcgggctgtgcctcttcctgccttggcccaacaatttcaggggttagatagcagcagctttctcaagagaaatcagtgggagtgcaaattagcagtgtcatttgggagagctgaggggctagatttccaagctcggctttcacagggaatggaccggtttcagggccactagccacccccgggctccagcttgctgtctttgctgaaaagcttcatgcagagcttctcagattggagcctgtcttggtacatgcttagctgaacaacacaaatgcgccgtggcccaggggtcccgtcctgccaggcctctctcctcagggagcccgtccatagggtcagttttgtcacagagcacaactggtaagatgcctaggtggaggagtgaaagagtcactgcgtttctgattttctggcaacgatttgactctgttttgctctgtaatgtatttaattatctgaatatttttctgttattagcctttgcttcacttttgtaaattagatactagttttgattgaaaaatgtaaaaagaatttatcttggagactgcttataaaaataatccccaattttgttgagtagccccataatactatcttttatttttgaaccaagatgtctctcctaaagtcttttgcaagcccaataaaaacaattgggacaccagtatctccttttgcttcttaaatgaaccagttgttccagatgtgcgaggagctgcttctgccactcagagcttgctggctgtgcctggaagggttcctacaagctgtgtgaagggagaatcattggcagggagttggtatatgagttgatcccatattcattattaataactaacacagcacccaggagctgccaagagcattcttcagctccactcaaatgcttctaactgaccctcctaagaaaatgagagcaaggggactagtgtgaatgacttacttctggctgagggtggctactggtgccttactgctgaatgttctagggcctgttttgggtagcaaagtacctggtccatgggaggatattcttgtccttatctttgtcagcagatttcccaagaaagcccccaaatgttgatcaagacagaaaataggccttttttgtcttttatggagatacactgtttaggctgatcagaaatgtctggtgatctactgcccggactatattaagccattttctagaagataggatattaatttaacaccacttgggcatattaagaaaattggagaaaattagtagtgagaatccagaaatcctcctttaacaagcaaggcacttgaggcgtctgtttaagggttcacagcccctgtctgtgtggttagatctgcccctgctcacttgactgccggttcttatctctaaatgcctttgggaatttacaatttatttggacttttggggggaattctctaatttatctgtgtttaaatgggtgctgtctcatacagtagtaagtttgcgtgagataaggtaacttttagaatgagagaaaaaaa

SEQ ID NO: 172593 - DNA, 813 bp, Homo sapiens
  Payload ID: 13933
  Gene Symbol: PYDC1
  Gene Name: PYD (pyrin domain) containing 1
  Uniprot ID: Q8WXC3
  ENST ID: ENST00000302964
  CDS Start-End: 332-601
acaaagccacttctttgctgggaggtgcctgaccatggaatcagttccattcctgcctcaatgacttgcaacctgtttcctcctctgcagattgggaacagcaatccccacctcaacaatttggcgcccccactctcccaggggaaactgggggaccctctaggcggtgtttgcagagtcccctcccagcaggagccacagggttgaataggagctgccagatcagtctccttcccgggacatccccgggggcggcagctccacctgctgcaggaaaggtaggacctgatggctccaggccctcggaggctcagaggcgcagggctgagccatgggaacgaagcgcgaggccatcctgaaggtgctggagaacctgacaccggaggagctcaagaagttcaagatgaagctggggacggtgccgctgcgcgagggctttgagcgcatcccgcggggcgcgctcgggcagctagatatcgtggacctcaccgacaagctggtcgcctcctactacgaggactacgcagccgagctcgtcgtggccgtgctgcgcgacatgcgcatgttggaggaggccgcacggctgcagcgggctgcgtgagggccactctgagctggaggcgggtcaaggcaaaaggagtaatgcaacgcctgtgaagccagccccacgcgcgcaccagtcgcgtaagacaacagcagtgtctccacctcggggaccaaggacgcctccgtgcctccagaccccgcctcctccagcccctgcacctgtcatttattcttccactgcccaataaatattcatggcagacttta

SEQ ID NO: 172594 - DNA, 990 bp, Homo sapiens
  Payload ID: 13934
  Gene Symbol: PYCARD
  Gene Name: PYD and CARD domain containing
  Uniprot ID: Q9ULZ3
  ENST ID: ENST00000247470
  CDS Start-End: 303-890
gcaggcgccacccatgagcccctctgcggccccctcccgggtcccacctcgcaggccagctggagggcgcgatcctggcgtcccccgacggcctggggccccaatccagaggcctgggtgggaggggaccaagggtgtagtaaggaagcgccttttgctggagggcaacggaccggggcggggagtcgggagaccagagtgggaggaaggcggggagtccaggttccgccccggagccgacttcctcctggtcggcggctgcagcggggtgagcggcggcagcggccggggatcctggagccatggggcgcgcgcgcgacgccatcctggatgcgctggagaacctgaccgccgaggagctcaagaagttcaagctgaagctgctgtcggtgccgctgcgcgagggctacgggcgcatcccgcggggcgcgctgctgtccatggacgccttggacctcaccgacaagctggtcagcttctacctggagacctacggcgccgagctcaccgctaacgtgctgcgcgacatgggcctgcaggagatggccgggcagctgcaggcggccacgcaccagggctctggagccgcgccagctgggatccaggcccctcctcagtcggcagccaagccaggcctgcactttatagaccagcaccgggctgcgcttatcgcgagggtcacaaacgttgagtggctgctggatgctctgtacgggaaggtcctgacggatgagcagtaccaggcagtgcgggccgagcccaccaacccaagcaagatgcggaagctcttcagtttcacaccagcctggaactggacctgcaaggacttgctcctccaggccctaagggagtcccagtcctacctggtggaggacctggagcggagctgaggctccttcccagcaacactccggtcagcccctggcaatcccaccaaatcatcctgaatctgatctttttatacacaatatacgaaaagccagcttgaac

SEQ ID NO: 172595 - DNA, 696 bp, Homo sapiens
  Payload ID: 13934
  Gene Symbol: PYCARD
  Gene Name: PYD and CARD domain containing
  Uniprot ID: Q9ULZ3
  ENST ID: ENST00000350605
  CDS Start-End: 67-597
ccgacttcctcctggtcggcggctgcagcggggtgagcggcggcagcggccggggatcctggagccatggggcgcgcgcgcgacgccatcctggatgcgctggagaacctgaccgccgaggagctcaagaagttcaagctgaagctgctgtcggtgccgctgcgcgagggctacgggcgcatcccgcggggcgcgctgctgtccatggacgccttggacctcaccgacaagctggtcagcttctacctggagacctacggcgccgagctcaccgctaacgtgctgcgcgacatgggcctgcaggagatggccgggcagctgcaggcggccacgcaccagggcctgcactttatagaccagcaccgggctgcgcttatcgcgagggtcacaaacgttgagtggctgctggatgctctgtacgggaaggtcctgacggatgagcagtaccaggcagtgcgggccgagcccaccaacccaagcaagatgcggaagctcttcagtttcacaccagcctggaactggacctgcaaggacttgctcctccaggccctaagggagtcccagtcctacctggtggaggacctggagcggagctgaggctccttcccagcaacactccggtcagcccctggcaatcccaccaaatcatcctgaatctgatctttttatacacaatatacgaaaagccagcttgaa

SEQ ID NO: 172596 - DNA, 1137 bp, Homo sapiens
  Payload ID: 13934
  Gene Symbol: PYCARD
  Gene Name: PYD and CARD domain containing
  ENST ID: ENST00000561508
  CDS Start-End: 761-1137
tggcttcaagttcatggtctttaatctcctggaggctgtctctctttcttttttcttttttttaatcagtgttgggatcaaattctggctcccctaggaagcatctggcaaggtttcgggagccatcgggttggccatgttatgctggaatatttataagcaccggagggttatccccatgtcgtagaaaatgaaactgaagctcagagagatttgcactctctgcccttttgtacaactcatttttccccagtatgtggaattgagggagcttcacgcttctagctgtcatgattccaagattctacgacatgtgggagaggatcctaaggttcggggaaccgcggaggtttcggggttctagaaatccgaggttctaagcctaggtgctccaataaacccagtgagagccagcccaggtttccggtctgtacccgctggtgcaagcccagagacaagcaggcgccacccatgagcccctctgcggccccctcccgggtcccacctcgcaggccagctggagggcgcgatcctggcgtcccccgacggcctggggccccaatccagaggcctgggtgggaggggaccaagggtgtagtaaggaagcgccttttgctggagggcaacggaccggggcggggagtcgggagaccagagtgggaggaaggcggggagtccaggttccgccccggagccgacttcctcctggtcggcggctgcagcggggtgagcggcggcagcggccggggatcctggagccatggggcgcgcgcgcgacgccatcctggatgcgctggagaacctgaccgccgaggagctcaagaagttcaagctgaagctgctgtcggtgccgctgcgcgagggctacgggcgcatcccgcggggcgcgctgctgtccatggacgccttggacctcaccgacaagctggtcagcttctacctggagacctacggcgccgagctcaccgctaacgtgctgcgcgacatgggcctgcaggagatggccgggcagctgcaggcggccacgcaccagggaggctccccacgcttggcctaccgaccaacgggaccccggccccacggcgggaagggaagggaaggggatcacttggcccatatccttccaggctctggagc

SEQ ID NO: 172597 - DNA, 8488 bp, Homo sapiens
  Payload ID: 13935
  Gene Symbol: PYGO1
  Gene Name: pygopus family PHD finger 1
  Uniprot ID: Q9Y3Y4
  ENST ID: ENST00000302000
  CDS Start-End: 96-1355
agtcaagtcgttaaaataccaagtggaggcattctacagacaggtgtccacaccacggccacgcggacacggagtcggggaatctggatccccacatgcccgccgagaactctccagctcccgcttacaaagtttcctcgcatggtggtgatagtggactggatgggttaggaggaccaggtgtacaactaggaagcccagataagaaaaagcgcaaggcaaatacacagggaccttctttccctccattgtctgagtatgctccaccaccgaatccaaactctgaccatctagtggctgctaatccatttgatgacaactataatactatttcctataaaccactaccttcgtcaaatccatatcttggccctggttatcctggctttggaggctatagtacattcagaatgccacctcacgttcccccaagaatgtcttccccatactgtggtccttactcactcaggaaccagccacacccatttcctcagaatcctctgggcatgggttttaatcgacctcatgcttttaactttgggccacatgataattcaagtttcggtaatccatcttataataatgcactaagtcagaatgtcaacatgcctaatcaacattttagacaaaatcctgctgaaaatttcagtcaaattcctccacagaatgctagccaagtttctaaccccgatttggcatctaattttgttcctggaaataattcaaattttacttctccgttagaatctaatcattcttttattcctcccccaaacacttttggtcaagcaaaagcaccacccccaaaacaagactttactcaaggagcaaccaaaaacactaatcaaaattcctctgctcatccacctcacttgaatatggatgacacagtgaatcagagtaatattgaattaaaaaatgttaatcgaaacaatgcagtaaatcaggagaacagccgttcaagtagcactgaagccacaaacaataaccctgcaaatgggacgcagaataagccacgacaaccaagaggtgcagcagatgcctgcaccacagaaaaaagcaataaatcctctcttcacccaaaccgtcatggccattcgtcttctgacccagtgtatccttgtggaatttgtacaaacgaggtgaacgatgatcaggatgccatcttatgtgaggcctcttgtcagaaatggtttcatcggatctgtactggaatgactgaaacagcttatggcctcttaactgcagaagcatctgcagtatggggctgtgatacctgtatggctgacaaagatgtccagttaatgcgtactagagaaacttttggtccatctgcagtgggcagtgatgcttaatcaaaggcattaactaaagtgggtttattttcctgtgcattgcagaagttcattgacacaggattttaatgttttacattatttttttaaatgcatacacaaaaacattatttacttagtttttattaatcacttcatcactagagcaaattttttattgtctttgcttgctgtcttaaatgagaataatgtatatgggggtgctttagaaacataaataaatgttagttgttgttatttatcacaaacataaaagcctcttgaaacttcaaaataatatataacaaatgtaggcaagttttaacttttaaaagttagaatcattgaaaaacgtgtatttcagtgctgaactttggttgtaccatattaaagatttagttcaaaaagtttatcaaggatccacttaacacgtcttcacaacataatatatgtaactgtaacatgggggaaagcatacatttttatggattaaaaaaataatagtatgacaccagattcctcctccactagggtctttggaatcaatgaatttcatatttcaagtgagttttcaggatatctgtttgtacagatacgagacagatcttagcatatagtaaattctcagtaagtattgttgattaacttgtggatggtaccacatgaaattgctaatattagatcagttgaaaattgactgcaattagtaaagttggtataacgtacgttcccagttgtgctatttagaattatgatagtattatgctcctacttttctttgatattgagttgtcttgttattgtttattgttttccagagaaatactatagtatccacagaagaattgtgaatacttttttataattttgaactgggacatattgcagatgaggaaggtagaaacatccatttggccttagagggctctgctagtaaaagaactactcagtggtggtttgaaaaatcttgttctggggatctgaatttcaaaaatgaaccctaggggagatcaaaatccattttaaacaaagatcaattaagagccaaagtgaaatctaacttgcaaacaacaatttgaagccttgcagcagacttaaggaattcccgctctgactggggaaaagtataaaaatggacctgagagtaccctcttgagggatgatcaagaatggagacagttggagttgtgctcattaagattcaaaacagcagaaatccatttttggagcagattataacctgtggccaaaaaaaaaaaatgtgtgctgtttgacagctaatggcaatttatacaatcattggaggctggtaaagctccctaatatgttgccaccattatcattgcaaccaaaaaaattctgaagattgtgtggtgatctacgaaagagataaataattactgttatttaaacccaagtgaaacaatgacggcagcagcatattatcaagaaatttaaattatgcatgaaaatgtgatttaaaaacaatgtcctttgggtaacacacaagaacctacactttcacagacaaggactcgacctcacatgtcacaagctactaaagcaaagttaagtgacttgggctatgaaattttgtcatgtccattttagtcactggacctttattccatggactactgtctatcatttggagctttttctaagaaacaatgcattccccaatcgagatgaagtaactggaagatgttaacaatttatacagcctaacaaatgatgaattttataaaagttagacctttaatattctgttggaagaaaactattcatgctcctgatgcatattttgattgaataaaacttatttttttaaatacattgttttaattttgacctacaaaaacagcaatttcatatggtacaaggtaatacaaggttttctccatttacccttgactagttagaggtgagtacaaaatattttcagtagttgtaaaatatttatctttacaattttaggaaacaaaatgatataaactatacttctaggtactcctttgtgtgaaaactttaccagttgaagcaggttaaaatgcagtattttgggctgacaggcatttgatggtgttcagtagtgtacttgaagatctcattttacttggattttttattatacatatttctctaaatgtttaaggacctagttatgttgctcctgaaagtttaatgagtgctgatttttaataaatgatgcactgtatgctgtatgcctagttgtagcatcagatcatgatttattattaccctgaatagagctagatgatagatattttgagtagaactttccagtgttctcaggagttaacactttacatggtagtacttgagttgtgatcattactaaaatcaattatgcagtttcttaaaccctttatctctttaagtttcagtagttagctgtttttgtgaaaatgaaataacttctcccaagctagtctaaaggtatgtgttatgcaatataattcattttctatttccacatagttgtttttaaaaacctacaaacaggtgaatttttattcaggtgtttaggtcttcaaagcaccttacttaaataagaatctgtaaatattcaaaagaaaaactcacggttcattctgatagtgaatcatagccaaactgtaatcatagctgatgaatagcgttcatgtgtttgaattaattttcctgctagttctacatttgtctctacataatgctaagtcaaaagttatatagatgcttttggatggaataagtgatgaactgtaagaatagccagatgataatttgtctgaagaaggctattatacaaactgaaatggcttcttaggataaatgataagctgccttcaactttaaaaatatgcagtgatggaaaaaaacacaggtggaattgtaccttttttggtataatccctttccttcactgaaagtcctcatcttacacacacacacacacacacacaccccccacagtttctccaacatccttgagttttgcttaaattcaacctggctaactatgagcatctaggtttactcaccaaagctaggttattgacagaaaggtgggtttttttttgttttttttgttttgttttgttttgtttttgttttttgccagtcttgctctgttgcccaggctggagtgcagtgatgagatctcggctcactgcaacgtctgccttcctggttcaagtgattctcctgcctcagcctcctgagtagctgggattacagtcgcccaccatcacacctggctaatttttgtatttttagtagagacgggttcaccatgttggccaggctggtgtcaaactcctgacctcaagtgatctgcccgcctcagcctcccaaagtgctgggattacaggtgtaagccaccacgcctggccagacagaaaattttaaaaagcatcagttcctttctcagaacttgacttgctcatgcactagagaatttgtggtccacatgcttctaggtgttactcgattcactaatactgaaacagctcagcttgtgaaagataaattgttcttcagacagagtgcttagaattagatttgtgatcagtgttttccttttgtgtgaaatactttagagtactgctataattgttattcaaattagaaggttatatacataaaactaaagattttcttgtactagtgcttattcttcataaacacagtgtaaagaaatctacttttttggtggtttgttttagactcccaactctgcctagtggcagaaaaacctcttaatagtgtgggtcatcataaaatctgccaactttaatccaaataagtatcaagagtcttcattcaatattctttcaaacttgtttgtctcgaacaaattagagttttagcacttattgttcaatgtactatagtaattgtatttaatagtaagaaaatatataagcaatgattttttaaaagggagttctcaagagttttggatttctttctgccgtgtatagaggtttcttatgcatggacatttgtgctgttttatatctttttcaattaaaaaaaaatttaaaggcatcaggctccctaagttcatttgtaaatagtggcttggaactctacacaatagggaagctcctaaaggctcatttagaccataatctagttaatagtatcatgctgaactctcagttttctttaggaaaccaatcaatcagtgtaggagggagaaagaagcagaggtcttgtctttttcctgatgtgattaggaggttaagttctttggtgtgggtttctttgcatttgcccccttaccatgctaaactctggtgaaatgtataagcagccttggcttttcctctcctgggtgctctgtgcttcaacattttatatctttcctcccatcagaaatcctgtgtctttgtgtggcagtagtagttggctagactttaagagaaaagcattttctactaaggtatgaatgaagatagtgggaaaagtgtcattaaatttcttttttaaaaaagtatgtttattaagaatgaatctttaatatctaacatttcagacaatatgaccgcatttcagataccatgggaagcagtacatttagtgaattagctggtactgtctgagggtacttccagtttcctttaggctgttgtgacttttcacagcttcctctcctctaattctgaacttagagattttcttctcatttctaatttttagtagcttattgttccatccagtagagcattataaaagtcacatctgcatcttccaacttatggtacagtgatgggaatttggaagcacccctggagcaaagaggctagggatagcattaacatctcccaagacaagtggtataggggaaatgaaggaaagactgtggccatgtatatgccaggcgttaatacatcagagctgcctgtatttaatttaaaacttttgatgaaactcagtggataagcatctttgtcatattttgtcaataatacattacttgcaattatattaaaacttattctaaatacctgtacctttcttgttctgtagatgtgtagatgatgttgcttgtttgtcaaaatattatcttttataaaagaaagtcctgcttcttatcatgatgtatgtgacttaaatgattgtttcatattaaaactatttcttccttatgtactgtttacatatacctctttttgggatattagttcagtacttttatacaaatctgagtgtgttccacattggtgacatgtatttttgcagtaactttttgttttgttcttagaacatgtctaaagtaacacatgcactagtgctgtggtctgtggcaaaattactgtaattcaaattggaaaaaaaaatgtttccagactttgtccaacatttattcctatggcaaaggaaattactatgtaatactaattatttcttatgctggtatgttttaagctactctatgaagtatgtgaaacatcaatatttatggattaatagatggcctgatgtctttcaaatgggagaggagtaaattttagtgttaccaactcatgacacttgtaatacaataaatcttaaaatttttattttccacttacaggtatactttactaaataattaccttaaatggcagtgcatattaggattttttagcacatactactaaaattatatagtaacttttaacttgtgctgatatttcccaaccaaaaaagacatcattcacttcatcataaccaaaataagtagtactgtaatatttatcttcatttatttagacatgattaagataccgtaagactcctctaatttacctggaatttttagccattgattcaaggacttgaatgctgtttacttggtactacctaatgaaaggatttggtaataaaggttataatcacgattttaaagaaaaatgtttcatcttgaaggcaaatttttaagctttttatttagaggtgtttacttaagaatagtaatttaaaagcattcttattttgtcattaagacaagtacccaaaagaattgtaataagtaatacttggccaatgcaaatttgtacatttgaaatcatacacttgaaagaaaaaaatgaaggcttgtgagtgcttaaactgcatatctttttaaaaattcaaattttagacatatcagtttaaattatccttaataaggttttactatgtcagtgatgtatattacaaaatgtctacctatgttatgttaatgatatctctatactgcatcatattcggcatggttatggtatattttgtacttttgattgtggactattgataggattgatatagcaataaatctgattcagacttaatattttttaaaacgctagataccatactgtatcataatcctattatatttgacttgaatgcccaaaattttcatagttctatattttatgttaaaaatttagtattacatgttagggatttatttttgtctgctattttcacatacattcttttagaactgagtctgtttctatttagatcatagacgtctaaagaagtattattaattcatgaactgctttgtggaaaaatttaaataaagtatgaaatgactagattaccccaaattgtttatttttttttttggttaatgaccaggttacaattctcagacaaatgaaattggcttgataactgattgaatatagtagataatggaaagtttgactctttaagggcttccaagtgttaaatacattctcaattctgaattacttcatagtaactacttaaataatggtaagccaattctcctttttctttttgagatatttaacacaatttgcgtcttctgatcccattcccttcttccccaaaaaccatgctagaatttaaaattggaagagtttaatttgtcatctacattttagtttttttattctatagataagtaagaagacaagtagacgttctgctgtcaagacagtccatgttattgttggccattcttttcagggataatgcttaatgttatttgtgcgttgtataaggaatgttgtttatcagtatatagacctaccattagtagaaatgatgtatggcaggctttcttgaataatatgtattgtaagtttgtttcctatagtgttattatggttcagattcttttaaataaagctagtttttaaaga

SEQ ID NO: 172598 - DNA, 2653 bp, Homo sapiens
  Payload ID: 13935
  Gene Symbol: PYGO1
  Gene Name: pygopus family PHD finger 1
  Uniprot ID: Q9Y3Y4
  ENST ID: ENST00000563719
  CDS Start-End: 58-1317
gcatcaaagagaccgaattcccgcggcctgggggggagtcatgctttgcggtctgtaatgtcagcagaacaggagaaggatcccatttcgctgaagagagttcgaggtggtgatagtggactggatgggttaggaggaccaggtgtacaactaggaagcccagataagaaaaagcgcaaggcaaatacacagggaccttctttccctccattgtctgagtatgctccaccaccgaatccaaactctgaccatctagtggctgctaatccatttgatgacaactataatactatttcctataaaccactaccttcgtcaaatccatatcttggccctggttatcctggctttggaggctatagtacattcagaatgccacctcacgttcccccaagaatgtcttccccatactgtggtccttactcactcaggaaccagccacacccatttcctcagaatcctctgggcatgggttttaatcgacctcatgcttttaactttgggccacatgataattcaagtttcggtaatccatcttataataatgcactaagtcagaatgtcaacatgcctaatcaacattttagacaaaatcctgctgaaaatttcagtcaaattcctccacagaatgctagccaagtttctaaccccgatttggcatctaattttgttcctggaaataattcaaattttacttctccgttagaatctaatcattcttttattcctcccccaaacacttttggtcaagcaaaagcaccacccccaaaacaagactttactcaaggagcaaccaaaaacactaatcaaaattcctctgctcatccacctcacttgaatatggatgacacagtgaatcagagtaatattgaattaaaaaatgttaatcgaaacaatgcagtaaatcaggagaacagccgttcaagtagcactgaagccacaaacaataaccctgcaaatgggacgcagaataagccacgacaaccaagaggtgcagcagatgcctgcaccacagaaaaaagcaataaatcctctcttcacccaaaccgtcatggccattcgtcttctgacccagtgtatccttgtggaatttgtacaaacgaggtgaacgatgatcaggatgccatcttatgtgaggcctcttgtcagaaatggtttcatcggatctgtactggaatgactgaaacagcttatggcctcttaactgcagaagcatctgcagtatggggctgtgatacctgtatggctgacaaagatgtccagttaatgcgtactagagaaacttttggtccatctgcagtgggcagtgatgcttaatcaaaggcattaactaaagtgggtttattttcctgtgcattgcagaagttcattgacacaggattttaatgttttacattatttttttaaatgcatacacaaaaacattatttacttagtttttattaatcacttcatcactagagcaaattttttattgtctttgcttgctgtcttaaatgagaataatgtatatgggggtgctttagaaacataaataaatgttagttgttgttatttatcacaaacataaaagcctcttgaaacttcaaaataatatataacaaatgtaggcaagttttaacttttaaaagttagaatcattgaaaaacgtgtatttcagtgctgaactttggttgtaccatattaaagatttagttcaaaaagtttatcaaggatccacttaacacgtcttcacaacataatatatgtaactgtaacatgggggaaagcatacatttttatggattaaaaaaataatagtatgacaccagattcctcctccactagggtctttggaatcaatgaatttcatatttcaagtgagttttcaggatatctgtttgtacagatacgagacagatcttagcatatagtaaattctcagtaagtattgttgattaacttgtggatggtaccacatgaaattgctaatattagatcagttgaaaattgactgcaattagtaaagttggtataacgtacgttcccagttgtgctatttagaattatgatagtattatgctcctacttttctttgatattgagttgtcttgttattgtttattgttttccagagaaatactatagtatccacagaagaattgtgaatacttttttataattttgaactgggacatattgcagatgaggaaggtagaaacatccatttggccttagagggctctgctagtaaaagaactactcagtggtggtttgaaaaatcttgttctggggatctgaatttcaaaaatgaaccctaggggagatcaaaatccattttaaacaaagatcaattaagagccaaagtgaaatctaacttgcaaacaacaatttgaagccttgcagcagacttaaggaattcccgctctgactggggaaaagtataaaaatggacctgagagtaccctcttgagggatgatcaagaatggagacagttggagttgtgctcattaagattcaaaacagcagaaatccatttttggagcagattataacctgtggccaaaaaaaaaaaatgtgtgctgtttgacagctaatggcaatttatacaatcattggaggctggtaaagctccctaatatgttgccaccattatcattgcaaccaaaaaaa

SEQ ID NO: 172599 - DNA, 1306 bp, Homo sapiens
  Payload ID: 13936
  Gene Symbol: PYGO2
  Gene Name: pygopus family PHD finger 2
  ENST ID: ENST00000368456
  CDS Start-End: 158-1267
gcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccgtggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctcc

SEQ ID NO: 172600 - DNA, 3146 bp, Homo sapiens
  Payload ID: 13936
  Gene Symbol: PYGO2
  Gene Name: pygopus family PHD finger 2
  Uniprot ID: Q9BRQ0
  ENST ID: ENST00000368457
  CDS Start-End: 173-1393
gtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtctgcaaatgaagagtccagaaaagaagcgaaggaagtcaaatactcagggccctgcatactcacatctgacggagtttgcaccacccccaactcccatggtggatcacctggttgcatccaacccttttgaagatgacttcggagcccccaaagtgggggttgcagcccctccattccttggcagtcctgtgcccttcggaggcttccgtgtgcaggggggcatggcgggccaggtacccccaggctacagcactggaggtggagggggcccccagccactccgtcgacagccaccccccttccctcccaatcctatgggccctgctttcaacatgcccccccagggtcctggctacccacccccaggcaacatgaactttcccagccaacccttcaaccagcctctgggtcaaaactttagtcctcccagtgggcagatgatgccgggcccagtggggggatttggtcccatgatctcacccaccatgggacagcctcccagagcagagctgggcccaccttctctgtcccaacgatttgctcagccaggggctccttttggcccttctcctctccagagacctggtcaggggctccccagcctgccgcctaacacaagtccctttcctggtccggaccctggctttcctggccctggtggtgaggatggggggaagcccttgaatccacctgcttctactgcttttccccaggagccccactcaggctccccggctgctgctgttaatgggaaccagcccagtttccccccgaacagcagtgggcggggtgggggcactccagatgccaacagcttggcaccccctggcaaggcaggtgggggctccgggccccagcctcccccaggcttggtgtacccatgtggtgcctgtcggagtgaggtgaacgatgaccaggatgccattctgtgtgaggcctcctgccagaaatggttccaccgtgagtgcacaggcatgactgagagcgcctatgggctgctgaccactgaagcttctgccgtctgggcctgcgatctctgcctcaagaccaaggagatccagtctgtctacatccgtgagggcatggggcagctggtggctgctaacgatgggtgacgctggtgaagtggcccagggaagtgcacatgtctctccctgctcttccagggtgatttttttgatgtttggctcttggtccttgtttccactggctttccatccccatggggcagaaacagtggctcctgggagcagaaaaggaattgaggtgggcaggcagaagagcctggattgctcactgttttgggaaacttacatgttgagatctacagagatccaggaaaccaaagccctgctgagcagagccattttgtggctatttctggaggcccaggagtgtggctgcaagagaaaaggggctggaggaagatccggagggcaggggtgttccctctgctgatgatggatgcccctaacacctgtgcctaacacccctactgaaccccacagctccagccttagtttttggagtcaagtgttaaaggtttctggccagaggaattggggtcttgccatccctgcaatagcccttttatgggctctgggagacagctttagggaataaatggggattttcccctttttctacccactcctttgcttcctccaagacttacccaactccttccccctcagagaaccaaatagcctgaggaagcaggagagttcctggttatggcagtttcttggtgatttggggcttcaagacagtaggtgagagatgctgtcaggacgtatcttcttcataccaaagtcactggtcctttctcagcctctctcgtgcttttctcctaatgaccatatttttgccaaaaattgggatatgttatctgacagaccagaatatttgaagtttgggctgtcctgaaagtctggactttggtggtaccctcctcccccagcccatctgttgcacattatactccgtgtgttcttcaactttcggcgcccttattcccctgccttcctggcttgattgaaggaaagcttgaaaaggcgcagagccctatacctcatttcctccatgataaaaggatccaagtgaggccctgtcacagcctgtgggtaggggatgcggcgggatcctcattgccatggtactcaaaggtagaagagcctggagtttgttgcttctctttgctattctttcatatcctcttgggcctggtgattaattagcaattctcattcctctcagccaaaggcctgcactgggctttatttgtctttttttattttttaagcactgcctgccagagatgggcctggggcctgatgaggaccttagcgctgctcgttctccttttctgttcatgcacacattcctccatggggtggggaaggcaggcatggggtgtggccctcggagaagttaggagtcccccagctcaagatacagtggcaaagacctagtggtcccctacccccacttctctcagttcctggcatgaggagagaagaccctgctctggtggagctgacaacctttgaggctgggaggagagcagcctctgggcatcgttcccagtgtccctcacactaaaacggcgtagatggcaaccccccacccccaccccgctgctcaactcttgtgtttgttgttctgtttgccccatttatctgttgctgtttttgtgttgtcttcccctgctccgcattttgtaaaatggcccctgggggagtgtttttgctggatctgctccctctcgctctctcactccactactttttggaacaaagtgatggcagaatgcggtggtggtgggggtcttttgtactgttggattaataaaatgattttaaaatccca

SEQ ID NO: 172601 - DNA, 1073 bp, Homo sapiens
  Payload ID: 13937
  Gene Symbol: PYM1
  Gene Name: PYM homolog 1, exon junction complex associated factor
  Uniprot ID: Q9BRP8
  ENST ID: ENST00000398213
  CDS Start-End: 4-615
aagatggcgactccctatgttactgacgagaccggcggcaagtatatcgcgtcaacacagcgacctgacgggacctggcgcaagcagcggagggtgaaagaaggatatgtgccccaggaggaggtcccagtatatgaaaacaagtatgtgaagtttttcaagagtaaaccagagttgcccccagggctaagccctgaggccactgctcctgtcaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactgagaaagccaagaagataaagaacctaaagaagaaactccggcaggtggaagagctgcagcagcggatccaggctggggaagtcagccagcctagcaaagagcagctagaaaagctagcaaggaggagggcgctagaagaggagttagaggacttggagttaggcctctgaggcctttggggaatagggaatggactgcagaacaaaccgtggggctctctggggtctgggggaatacgggcaacagcagtcaggaggggtaccccccatactggcttacttccacctcctgcggcccagctctgtcctccagagcctagcgtctccctcaatccttcccttttcttcccaacttctactttttggactttccccctcccattcccagtgttcaaaatctcagtgactaccccaggtacctttgctgctgatttgggtgtcttgtttaaaagaaaatcaggtgggtgggaatctcttggagaactgaggctgagggtagagggagtatgcccaagtcttggagtcttggttcctgttcgcggtgtttatgggttatttccctctccatccctcattttttttttttttttaaaaaaagcaaaaatgagaataaacacaagtagacatgt

SEQ ID NO: 172602 - DNA, 1226 bp, Homo sapiens
  Payload ID: 13937
  Gene Symbol: PYM1
  Gene Name: PYM homolog 1, exon junction complex associated factor
  Uniprot ID: Q9BRP8
  ENST ID: ENST00000408946
  CDS Start-End: 153-767
gggcccagcccgaggaggcactcagggttaggaggtctgggcgagaagcaactagggccctcatcacttcgccgccgaatccccggcgccgcccagcggggcagagccaggccagggccgcccgcccaacctggtccgctgcctcttcggccatggaagctgccggcagccctgcggctacggagacaggcaagtatatcgcgtcaacacagcgacctgacgggacctggcgcaagcagcggagggtgaaagaaggatatgtgccccaggaggaggtcccagtatatgaaaacaagtatgtgaagtttttcaagagtaaaccagagttgcccccagggctaagccctgaggccactgctcctgtcaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactgagaaagccaagaagataaagaacctaaagaagaaactccggcaggtggaagagctgcagcagcggatccaggctggggaagtcagccagcctagcaaagagcagctagaaaagctagcaaggaggagggcgctagaagaggagttagaggacttggagttaggcctctgaggcctttggggaatagggaatggactgcagaacaaaccgtggggctctctggggtctgggggaatacgggcaacagcagtcaggaggggtaccccccatactggcttacttccacctcctgcggcccagctctgtcctccagagcctagcgtctccctcaatccttcccttttcttcccaacttctactttttggactttccccctcccattcccagtgttcaaaatctcagtgactaccccaggtacctttgctgctgatttgggtgtcttgtttaaaagaaaatcaggtgggtgggaatctcttggagaactgaggctgagggtagagggagtatgcccaagtcttggagtcttggttcctgttcgcggtgtttatgggttatttccctctccatccctcattttttttttttttttaaaaaaagcaaaaatgagaataaacacaagtagacatgtc

SEQ ID NO: 172603 - DNA, 884 bp, Homo sapiens
  Payload ID: 13937
  Gene Symbol: PYM1
  Gene Name: PYM homolog 1, exon junction complex associated factor
  ENST ID: ENST00000454792
  CDS Start-End: 191-424
gggcgagaagcaactagggccctcatcacttcgccgccgaatccccggcgccgcccagcggggcagagccaggccagggccgcccgcccaacctggtccgctgcctcttcggccatggaagctgccggcagccctgcggctacggagacagcttctccactcttcctcctcctccacctccgcccatgaaatggtgcactctccctttaagactaagatggtggcttgctacgatcgggactccacttccggtggggaggggggcgggaccccagcccgctcacgccggaagtggtttgcgttttcaagatggcgactccctatgttactgacgagaccggcggggtgggaaccgccaaacctctcccttctttttgacttcacccttggataccatcaaggccagaggatggaaccaagataacataaaataggtgctcctttgtgataatgggctatttgtatctctgagggcttccacacaggatggccattcaagaagcttctgctctgcctttcattacagtctatctttagtcctcctaaaccttcagctataatctctatgcaatcaacttaaatatatgtttgtagtattgtccctttctcccaaattccatgtaaaacacttgcctgaattgaattgtttccacaaagttgttttcccctgtggactttgtttatatcagtagtttttattttcccaattttccaaattcaagagtgataattataaatagttgtgttcttgtttgttatctttctcactagaatgtatactctaagaaggcaagaaccttgcttgctttattcattgttgtattcctagcttctgttacagtgtctggcacaagagtaagtgctcaataaaaatttaaaatcca

SEQ ID NO: 172604 - DNA, 499 bp, Homo sapiens
  Payload ID: 13937
  Gene Symbol: PYM1
  Gene Name: PYM homolog 1, exon junction complex associated factor
  ENST ID: ENST00000547925
  CDS Start-End: 13-150
gaggctgaagagatgcccagtaatatttgccattcttcctcaggaaggctcatttctcctatcaaggtgaaaagtgagattcagactcaggcaagtatatcgcgtcaacacagcgacctgacgggacctggcgcaagcagcggagggtgaaagaaggatatgtgccccaggaggaggtcccagtatatgaaaacaagtatgtgaagtttttcaagagtaaaccagagttgcccccagggctaagccctgaggccactgctcctgtcaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactga

SEQ ID NO: 172605 - DNA, 653 bp, Homo sapiens
  Payload ID: 13937
  Gene Symbol: PYM1
  Gene Name: PYM homolog 1, exon junction complex associated factor
  ENST ID: ENST00000549939
  CDS Start-End: 1-113
agctgccggcagccctgcggctacggagacaggggtgggaaccgccaaacctctcccttctttttgacttcacccttggataccatcaaggccagaggatggaaccaagataacataaaataggtgctcctttgtgataatgggctatttgtatctctgagggcttccacacaggatggccattcaagaagcttctgctctgcctttcattacagtctatctttagtcctcctaaaccttcagctataatctctatgcaatcaacttaaatatatgtttgtagtattgtccctttctcccaaattccatgtaaaacacttgcctgaattgaattgtttccacaaagttgttttcccctgtggactttgtttatatcagtagtttttattttcccaattttccaaattcaagagtgataattataaatagttgtgttcttgtttgttatctttctcactagaatgtatactctaagaaggcaagaaccttgcttgctttattcattgttgtattcctagcttctgttacagtgtctggcacaagagtaagtgctcaataaaaatttaaaatccacgtgtgaataaatgtgattaccatgtgccctaccgtatattgagaaaaataagaatacatgtgaaaagcacgagattaaa

SEQ ID NO: 172606 - DNA, 775 bp, Homo sapiens
  Payload ID: 13937
  Gene Symbol: PYM1
  Gene Name: PYM homolog 1, exon junction complex associated factor
  ENST ID: ENST00000557259
  CDS Start-End: 222-356
agggttagatagggtctccaaccgtccctagaaacacttgtgcgccccagtgcgttcctggagtttgtctgctccacgtcaccaagccgctctgagatctgggtgcaggccagagcctggatattcttcctttcttcatttataaggccccctttttgggtgcaggtgggccttgcgcccttttccctcgcaggtcctggacgtacgaggagttcctggggatgagagggactgtgcctcggaacttctcttggctccctgaggactgttttacaggcagcaagcgctcagtaatggcaagtatatcgcgtcaacacagcgacctgacgggacctggcgcaagcagcggagggtgaaagaaggatatgtgccccaggaggaggtcccagtatatgaaaacaagtatgtgaagtttttcaagagtaaaccagagttgcccccagggctaagccctgaggccactgctcctgtcaccccatccaggcctgaaggtggtgaaccaggcctctccaagacagccaaacgtaacctgaagcgaaaggagaagaggcggcagcagcaagagaaaggagaggcagaggccttgagcaggactcttgataaggtgtccctggaagagacagcccaactccccagtgctccacagggctctcgggcagcccccacagctgcatctgaccagcctgactcagctgccaccactgagaaagccaagaagataaagaacctaaagaagaaactccggcaggtggaagagctgcagcagcggatccag

SEQ ID NO: 172607 - DNA, 4055 bp, Homo sapiens
  Payload ID: 13938
  Gene Symbol: PYROXD1
  Gene Name: pyridine nucleotide-disulphide oxidoreductase domain 1
  Uniprot ID: Q8WU10
  ENST ID: ENST00000240651
  CDS Start-End: 55-1557
cagagtcccgttgctccgccgcgatattcagtaaaccactgggagtccggcagcatggaggcagcgcgccctcccccgacggcagggaagttcgtggtggtcggcggcggcatcgcgggcgtcacttgtgcggagcagttggctactcactttccatcggaagatattctcttggtaacagcttctcctgttattaaagcagttacaaatttcaagcagatttctaaaatattggaagaattcgatgttgaagaacaatcaagtaccatgttaggaaaacgctttcccaacattaaggttatagaatctggcgtaaagcaactgaagagtgaagaacactgcattgtaacagaagatggcaatcagcacgtatataagaaactctgtctgtgtgctggagctaaaccaaagttgatatgtgaaggaaatccttatgtattaggaatccgtgatacagacagtgctcaggaatttcagaaacagcttactaaagctaaaagaataatgatcatagggaacggtggtattgcacttgagttagtgtatgaaattgaaggctgtgaagtgatttgggccattaaagataaagctatagggaatactttcttcgatgcaggagcagctgaattcttgacttcaaagctcattgctgaaaaatcagaggctaaaattgcacataaaagaaccagatatacaactgaaggaaggaaaaaggaagctagaagcaaatctaaagcagataatgtaggaagtgcattgggaccagattggcatgaaggcttgaatcttaaaggaacaaaagagttttctcataagattcaccttgaaactatgtgtgaagtaaagaaaatctaccttcaggatgagtttagaattttgaagaaaaagtccttcacttttccaagagaccataagtcagttacagctgatacagagatgtggcctgtctatgtggaattgaccaatgaaaagatatatggctgcgatttcattgtcagtgctacaggagttacaccaaatgtagaaccttttctccatggtaacagttttgatctaggagaagatggtggcctgaaagtggatgatcatatgcacacatcccttcctgatatctatgctgccggtgacatctgtactacatcctggcagctgagcccagtctggcagcagatgaggctgtggacccaggctagacagatgggatggtatgcagcaaagtgcatggctgcagcgagttcaggagactctattgacatggatttcagctttgaactgtttgctcatgtgacaaaattttttaactataaggttgtactgctgggaaaatacaatgcacagggcttaggttcagatcatgaattaatgctgagatgtaccaaaggacgagaatacatcaaagtcgtcatgcaaaatggacgaatgatgggagctgtcttaattggtgaaaccgatttagaagaaacatttgaaaacctaatcttaaaccaaatgaatctttcatcatatggagaagatctgctagatccaaatattgatatagaagattattttgactaaaaatggaatttcttcaggaatcatataaagttccaaatgacaccagaaaaatcacaagtcaataaaatgaatgactgtattgagttaatgatgaccacactgaaaattacagaagtgataatgatattagtggaaaaatataaaaacataaattctaagtttgaaatcagttcaaagtttatttatagatatatctttccaatacaacactgaccgcttagataaaaatcttaagttatttatttctgtgttttaaacataaatatgtttacttgtgatttagctttggagcaaatttaggtaagttatctacttagccaaatgtactctagtagactagaaccattctttgtgaaatgtcaaaatatggctatggtttcaggaactttaaaatcggttgtattttactttaaatagagatgtagcaatatctcgtttgctaatatttatattgatgacttactccttttttgttgaattgtacttctggttttataacctgaaatcatctacaagcttgtccaactctagcccacgggtctaatgcagcccagaacagctttgaatgcagcccaacacaaatctgtaaactttcttaaaacatgagatttttcttgcaatttttttttttttaagctcatcagctatcgtcagtgttagcatattttatgtgcggcccaagacaattcttcttccaatgtggctcagggaagccaaaagattggacatccctgatctacatatttaacttaaagtatcactcagtgaacctctgtcagtataatattgctttcaaaaagatggttatgtcaaaagaaaaaatatagctaagtatataaaggcataaaaaacttaagacaattacatgaacttattctcaaatattttacattttttgtaaactttcttaaaacatgagatttttcttgcaattttttttttaagctcatcagctatcatcagtgttagcatattttatgtgcggcccaagacaattcttcttccaatgtggctcagggaagccaaaagattggacatccttgatctacatatttaacttaaagtatcactcagtgagcctctgtcagtataatattgctttcaaaaagatagttatgtcaaaagaaaaaatatagctaagtatataaaggcataaaaaacttaagacgattgtatgaacttattctcaaatattttacatttaaagggttttacataaaaatttttcccttgttttatactggaaaattatataattcatgatctctaattttcaaacattctcaaaagtttagatcttcagagataagctctgaaaatatagatccatacatataaaatatctatgaaattcttttaaaaactattgtctaactacaaaaataatggcatatacatgcataaaccatctttaattagaaaatttagtaacattcatatcaggcatcatcgatttttcttttcttagctcctgtattcttagaaccagattgctgaagcatgtttgcagccttcttctggaagttgcctgaatttttttcctccatctttttatcaccttgttcagaatgacaagtttgagacgattcagcctacaaaaaaaaaaaaaaaacaaagcaagcaccttggtaaaaatccagctattcagttttctcatgagattaaatatttcaaaatattctttctgtatcagttggctttttaagtatacaggggtctagttttttatctacaaatttctattcaaatatgagctctattttgaataaaaggggctacgttgtgagagaagttctaaagacctcaaatgtccttagacacaatggcacttgacttgacatgcttttgcagacttgatagtatttggtttaaaacagtggtttctaaccactggaacagcagaaacagacttctcaactattagtaatcacaaccaaataagagcagagtgcataacaaaattagatattcaaacggagtcctcccattccaagaaactggaaacccctagtttatgttaaaaggccagtctaaattctttcacttacatctttacagaaaactatattttctctcttccatacccagaaatctaatcagaaaactgacttttctcatgttcaactggacctaggggaatatgacagaaaagcatcccataggctttaatatactttttaaaatatataaaactgaaaattaatagccatttaccctgaaagagttctgcgtggactttgtcacttgcatagtaatagcatgtgcctcattgttcagaagattagctttaggtcctattttcaaatacgaaatggtagcataagctgtaaaactgtagtcttctctgcagaaaataaaggccaacaataagaaagcttttgaaggaatcacggaaaacaaatttataaaagaaataactatatgcgcagtaattcttaacacattgacttgaaataataaaatttacaagaatgcaaataaagcctttaaagaaaata

SEQ ID NO: 172608 - DNA, 1849 bp, Homo sapiens
  Payload ID: 13938
  Gene Symbol: PYROXD1
  Gene Name: pyridine nucleotide-disulphide oxidoreductase domain 1
  ENST ID: ENST00000375266
  CDS Start-End: 87-254
accgcctcgcggctgcttcctctcctggagtccagagtcccgttgctccgccgcgatattcagtaaaccactgggagtccggcagcatggaggcagcgcgccctcccccgacggcagggaagttcgtggtggtcggcggcggcatcgcgggcgtcacttgtgcggagcagttggctactcactttccatcggaagatattctcttggtaacagcttctcctgttattaaagcagttacaaatttcaagcagtagagacggggtttcaccatattggccaggctggtctggaactcctgacctcgtgatccatccacctcggcctcccaaattgctgggattacagatttctaaaatattggaagaattcgatgttgaagaacaatcaagtaccatgttaggaaaacgctttcccaacattaaggttatagaatctggcgtaaagcaactgaagagtgaagaacactgcattgtaacagaagatggcaatcagcacgtatataagaaactctgtctgtgtgctggagctaaaccaaagttgatatgtgaaggaaatccttatgtattaggaatccgtgatacagacagtgctcaggaatttcagaaacagcttactaaagctaaaagaataatgatcatagggaacggtggtattgcacttgagttagtgtatgaaattgaaggctgtgaagtgatttgggccattaaagataaagctatagggaatactttcttcgatgcaggagcagctgaattcttgacttcaaagctcattgctgaaaaatcagaggctaaaattgcacataaaagaaccagatatacaactgaaggaaggaaaaaggaagctagaagcaaatctaaagcagataatgtaggaagtgcattgggaccagattggcatgaaggcttgaatcttaaaggaacaaaagagttttctcataagattcaccttgaaactatgtgtgaagtaaagaaaatctaccttcaggatgagtttagaattttgaagaaaaagtccttcacttttccaagagaccataagtcagttacagctgatacagagatgtggcctgtctatgtggaattgaccaatgaaaagatatatggctgcgatttcattgtcagtgctacaggagttacaccaaatgtagaaccttttctccatggtaacagttttgatctaggagaagatggtggcctgaaagtggatgatcatatgcacacatcccttcctgatatctatgctgccggtgacatctgtactacatcctggcagctgagcccagtctggcagcagatgaggctgtggacccaggctagacagatgggatggtatgcagcaaagtgcatggctgcagcgagttcaggagactctattgacatggatttcagctttgaactgtttgctcatgtgacaaaattttttaactataaggttgtactgctgggaaaatacaatgcacagggcttaggttcagatcatgaattaatgctgagatgtaccaaaggacgagaatacatcaaagtcgtcatgcaaaatggacgaatgatgggagctgtcttaattggtgaaaccgatttagaagaaacatttgaaaacctaatcttaaaccaaatgaatctttcatcatatggagaagatctgctagatccaaatattgatatagaagattattttgactaaaaatggaatttcttcaggaatcatataaagttccaaatgacaccagaaaaatcacaagtcaataaaatgaatgactgtattgagttaatgatgaccacactgaaaattacagaagtgataatgatattagtggaaaaatataaaaacataaattctaagtttgaaa

SEQ ID NO: 172609 - DNA, 3639 bp, Homo sapiens
  Payload ID: 13938
  Gene Symbol: PYROXD1
  Gene Name: pyridine nucleotide-disulphide oxidoreductase domain 1
  Uniprot ID: Q8WU10
  ENST ID: ENST00000538582
  CDS Start-End: 754-2043
ccttttttgctgcgcccttttccgcacttattgctcccagattttagaaactgcttggtggtcctcagatgacctcactagctttctcttaggcgcagggaggagtgggaggcaaattatagccgagaaaccaaagctggctgatccgtgctcagatccttgtaatgtcagagcagacatgaggactttgtatttagacaaaaaattcagccccctttctttttatttttttttctttttctttgagacggagtctcactctgtcgcccagactggagggcagtggtgcgatcttggcttaatgcaagctttgcctcccgggttcaagcgattcttctgttgcgtcagcctgtagctgggattacaggcgccagccaccacgccccgctaatgtttgtatttttagtagagacgggctttcaccatgttggccaggctggtctcgaactcctgggctcaagcagtctgcccgcttccgcctaccgaagtgctggcattacaggcctgagccacagcacccggccctcagccccctttgttaattatcgtaggtgattgagtttagtttccagatagttgccaagtctttagtgcatcttaactaattaataaagaatcccatatttggctactcactttccatcggaagatattctcttggtaacagcttctcctgttattaaagcagttacaaatttcaagcagatttctaaaatattggaagaattcgatgttgaagaacaatcaagtaccatgttaggaaaacgctttcccaacattaaggttatagaatctggcgtaaagcaactgaagagtgaagaacactgcattgtaacagaagatggcaatcagcacgtatataagaaactctgtctgtgtgctggagctaaaccaaagttgatatgtgaaggaaatccttatgtattaggaatccgtgatacagacagtgctcaggaatttcagaaacagcttactaaagctaaaagaataatgatcatagggaacggtggtattgcacttgagttagtgtatgaaattgaaggctgtgaagtgatttgggccattaaagataaagctatagggaatactttcttcgatgcaggagcagctgaattcttgacttcaaagctcattgctgaaaaatcagaggctaaaattgcacataaaagaaccagatatacaactgaaggaaggaaaaaggaagctagaagcaaatctaaagcagataatgtaggaagtgcattgggaccagattggcatgaaggcttgaatcttaaaggaacaaaagagttttctcataagattcaccttgaaactatgtgtgaagtaaagaaaatctaccttcaggatgagtttagaattttgaagaaaaagtccttcacttttccaagagaccataagtcagttacagctgatacagagatgtggcctgtctatgtggaattgaccaatgaaaagatatatggctgcgatttcattgtcagtgctacaggagttacaccaaatgtagaaccttttctccatggtaacagttttgatctaggagaagatggtggcctgaaagtggatgatcatatgcacacatcccttcctgatatctatgctgccggtgacatctgtactacatcctggcagctgagcccagtctggcagcagatgaggctgtggacccaggctagacagatgggatggtatgcagcaaagtgcatggctgcagcgagttcaggagactctattgacatggatttcagctttgaactgtttgctcatgtgacaaaattttttaactataaggttgtactgctgggaaaatacaatgcacagggcttaggttcagatcatgaattaatgctgagatgtaccaaaggacgagaatacatcaaagtcgtcatgcaaaatggacgaatgatgggagctgtcttaattggtgaaaccgatttagaagaaacatttgaaaacctaatcttaaaccaaatgaatctttcatcatatggagaagatctgctagatccaaatattgatatagaagattattttgactaaaaatggaatttcttcaggaatcatataaagttccaaatgacaccagaaaaatcacaagtcaataaaatgaatgactgtattgagttaatgatgaccacactgaaaattacagaagtgataatgatattagtggaaaaatataaaaacataaattctaagtttgaaatcagttcaaagtttatttatagatatatctttccaatacaacactgaccgcttagataaaaatcttaagttatttatttctgtgttttaaacataaatatgtttacttgtgatttagctttggagcaaatttaggtaagttatctacttagccaaatgtactctagtagactagaaccattctttgtgaaatgtcaaaatatggctatggtttcaggaactttaaaatcggttgtattttactttaaatagagatgtagcaatatctcgtttgctaatatttatattgatgacttactccttttttgttgaattgtacttctggttttataacctgaaatcatctacaagcttgtccaactctagcccacgggtctaatgcagcccagaacagctttgaatgcagcccaacacaaatctgtaaactttcttaaaacatgagatttttcttgcaatttttttttttttaagctcatcagctatcgtcagtgttagcatattttatgtgcggcccaagacaattcttcttccaatgtggctcagggaagccaaaagattggacatccctgatctacatatttaacttaaagtatcactcagtgaacctctgtcagtataatattgctttcaaaaagatggttatgtcaaaagaaaaaatatagctaagtatataaaggcataaaaaacttaagacaattacatgaacttattctcaaatattttacattttttgtaaactttcttaaaacatgagatttttcttgcaattttttttttaagctcatcagctatcatcagtgttagcatattttatgtgcggcccaagacaattcttcttccaatgtggctcagggaagccaaaagattggacatccttgatctacatatttaacttaaagtatcactcagtgagcctctgtcagtataatattgctttcaaaaagatagttatgtcaaaagaaaaaatatagctaagtatataaaggcataaaaaacttaagacgattgtatgaacttattctcaaatattttacatttaaagggttttacataaaaatttttcccttgttttatactggaaaattatataattcatgatctctaattttcaaacattctcaaaagtttagatcttcagagataagctctgaaaatatagatccatacatataaaatatctatgaaattcttttaaaaactattgtctaactacaaaaataatggcatatacatgcataaaccatctttaattagaaaatttagtaacattcatatcaggcatcatcgatttttcttttcttagctcctgtattcttagaaccagattgctgaagcatgtttgcagccttcttctggaagttgcctgaatttttttcctccatctttttatcaccttgttcagaatgacaagtttgagacgattcagcctac

SEQ ID NO: 172610 - DNA, 1471 bp, Homo sapiens
  Payload ID: 13938
  Gene Symbol: PYROXD1
  Gene Name: pyridine nucleotide-disulphide oxidoreductase domain 1
  ENST ID: ENST00000544970
  CDS Start-End: 27-446
cagtaaaccactgggagtccggcagcatggaggcagcgcgccctcccccgacggcagggaagttcgtggtggtcggcggcggcatcgcgggcgtcacttgtgcggagcagttggctactcactttccatcggaagatattctcttggtaacagcttctcctgttattaaagcagttacaaatttcaagcagatttctaaaatattggaagaattcgatgttgaagaacaatcaagtaccatgttaggaaaacgctttcccaacattaaggttatagaatctggcgtaaagcaactgaagagtgaagaacactgcattgtaacagaagatggcaatcagcacgtatataagaaactctgtctgtgtgctggagctaaaccaaagttgatatgtgaaggaaatccttatgtattaggaatccgtgatacagacagtgctcaggtatgaaattgaaggctgtgaagtgatttgggccattaaagataaagctatagggaatactttcttcgatgcaggagcagctgaattcttgacttcaaagctcattgctgaaaaatcagaggctaaaattgcacataaaagaaccagatatacaactgaaggaaggaaaaaggaagctagaagcaaatctaaagcagataatgtaggaagtgcattgggaccagattggcatgaaggcttgaatcttaaaggaacaaaagagttttctcataagattcaccttgaaactatgtgtgaagtaaagaaaatctaccttcaggatgagtttagaattttgaagaaaaagtccttcacttttccaagagaccataagtcagttacagctgatacagagatgtggcctgtctatgtggaattgaccaatgaaaagatatatggctgcgatttcattgtcagtgctacaggagttacaccaaatgtagaaccttttctccatggtaacagttttgatctaggagaagatggtggcctgaaagtggatgatcatatgcacacatcccttcctgatatctatgctgccggtgacatctgtactacatcctggcagctgagcccagtctggcagcagatgaggctgtggacccaggctagacagatgggatggtatgcagcaaagtgcatggctgcagcgagttcaggagactctattgacatggatttcagctttgaactgtttgctcatgtgacaaaattttttaactataaggttgtactgctgggaaaatacaatgcacagggcttaggttcagatcatgaattaatgctgagatgtaccaaaggacgagaatacatcaaagtcgtcatgcaaaatggacgaatgatgggagctgtcttaattggtgaaaccgatttagaagaaacatttgaaaacctaatcttaaaccaaatgaatctttcatcatatggagaagatctgctagatccaaatattgatatagaagattattttgactaaaaatggaatttcttca

SEQ ID NO: 172611 - DNA, 1047 bp, Homo sapiens
  Payload ID: 13938
  Gene Symbol: PYROXD1
  Gene Name: pyridine nucleotide-disulphide oxidoreductase domain 1
  ENST ID: ENST00000543476
  CDS Start-End: 117-536
gtcggattatctggtaaggcaccggaagtgaccgcctcgcggctgcttcctctcctggagtccagagtcccgttgctccgccgcgatattcagtaaaccactgggagtccggcagcatggaggcagcgcgccctcccccgacggcagggaagttcgtggtggtcggcggcggcatcgcgggcgtcacttgtgcggagcagttggctactcactttccatcggaagatattctcttggtaacagcttctcctgttattaaagcagttacaaatttcaagcagatttctaaaatattggaagaattcgatgttgaagaacaatcaagtaccatgttaggaaaacgctttcccaacattaaggttatagaatctggcgtaaagcaactgaagagtgaagaacactgcattgtaacagaagatggcaatcagcacgtatataagaaactctgtctgtgtgctggagctaaaccaaagttgatatgtgaaggaaatccttatgtattaggaatccgtgatacagacagtgctcaggtatgaaattgaaggctgtgaagtgatttgggccattaaagataaagctatagggaatactttcttcgatgcaggagcagctgaattcttgacttcaaagctcattgctgaaaaatcagaggctaaaattgcacataaaagaaccagatatacaactgaaggaaggaaaaaggaagctagaagcaaatctaaagcagataatgtaggaagtgcattgggaccagattggcatgaaggcttgaatcttaaaggaacaaaagagttttctcataagattcaccttgaaactatgtgtgaagtaaagaaaatctaccttcaggatgagtttagaattttgaagaaaaagtccttcacttttccaagagaccataagtcagttacagctgatacagagatgtggcctgtctatgtggaattgaccaatgaaaagatatatggctgcgatttcattgtcagtgctacaggagttacaccaaatgtagaaccttttctccatggtaacagtgtaagtttgatc

SEQ ID NO: 172612 - DNA, 411 bp, Homo sapiens
  Payload ID: 13938
  Gene Symbol: PYROXD1
  Gene Name: pyridine nucleotide-disulphide oxidoreductase domain 1
  ENST ID: ENST00000544187
  CDS Start-End: 1-182
aaaaatcagaggctaaaattgcacataaaagaaccagatatacaactgaaggaaggaaaaaggaagctagaagcaaatctaaagcagataatgtaggaagtgcattgggaccagattggcatgaaggcttgaatcttaaaggaacaaaagagcaatactcacagcatcctcaccagaagtaaactccatctcagataactacgttctttgctcatccatgagaaacaacaactcatcttttcaaattttatcatgagattgcagcaatgtagtctcatcttcaggattcatttctaattacagttcttttgttatttccaccatatctgcctttctccattgaaatcttgaatccctcaaagtcatccatgaagttttctcataagattcaccttgaaactatgtgtgaag

SEQ ID NO: 172613 - DNA, 2028 bp, Homo sapiens
  Payload ID: 13939
  Gene Symbol: PYROXD2
  Gene Name: pyridine nucleotide-disulphide oxidoreductase domain 2
  Uniprot ID: Q8N2H3
  ENST ID: ENST00000370575
  CDS Start-End: 50-1795
ccaatcgctagcaaactccctgcctagcaaggcccagcctggggcagaaatggctgcaagtggccgaggtctctgcaaggctgtggccgcctctcccttcccggcgtggagacgagataacacggaagccaggggaggtctgaagcctgagtatgatgcggtggtgataggagcaggacacaacggactggtggctgcagcgtacctgcagagactgggggtgaacaccgccgtcttcgagaggcgccatgtgatcgggggtgcagctgtcactgaggagatcatcccagggtttaagttctcccgcgcgtcctacctgctcagcctgctgaggccgcagatttacactgatctggagctgaagaaacatgggctgaggcttcatcttcgaaacccctactccttcacccccatgctggaagagggtgcaggcagcaaggtgcccaggtgccttctgctgggcacagacatggcagaaaaccagaagcagatcgcccagttctcccagaaggatgcccaggtctttcccaaatatgaggagttcatgcatcgcttggcattagccattgaccctctgctggatgcggcccccgtggacatggcggccttccagcatggctccttgctgcaaaggatgaggtcgctctccaccctcaagcccctgctgaaggcaggccgcatcctgggagcccagcttccccgatattatgaggtcctcacagctcccattaccaaggtgctggatcagtggttcgagtctgagcctttaaaagccactctagccacagatgcagtgattggagccatgacaagtccccacactccggggagtgggtatgtgctgctgcaccatgtgatggggggcctggagggaatgcagggggcctggggctacgtccaggggggcatgggtgccctctctgatgcgatcgcaagctcagccaccacacatggagcaagcatcttcactgaaaagacagtggcgaaggtgcaggtgaacagtgaaggctgtgttcaaggagttgtgctggaagatggcacagaggtgagaagcaaaatggtgctgtccaacacatcaccgcagatcaccttcctgaagctgacgccacaggagtggcttcctgaggagttcctggagagaatctctcagctggacacccggtcgcctgtcaccaagatcaatgtggccgtagacaggctgcccagcttcctggcggcccccaatgctcccaggggccagccgctgccccatcaccaatgctccatccacctgaactgtgaagacaccctcctccttcatcaggcctttgaagatgccatggatggcctgccttcccacaggcctgtgattgagctctgcatcccttcctcgctggaccccaccctggctccccctggctgccatgtagtctccctcttcactcagtacatgccctatacgctggctggaggcaaggcctgggacgagcaggagagagacgcttatgcagacagagtgtttgattgcatcgaggtctatgcccctggcttcaaggactctgtggttggcagagacatcctcacaccaccagatttggagagaatcttcgggcttcctggagggaacatattccactgcgccatgtccctggaccagctctacttcgcccgccccgtgcccctgcattctggctaccgctgccctctccagggcctgtatctctgtggaagtggggctcatcctggaggaggtgtgatgggagctgctgggcgaaatgcagcacatgtggcctttagggacctcaagagcatgtgaccctgaaccagctctgacccaggaagaagactccacccctgaattccaagtgctccattggatcagcttcccaggaagttcagcttcgggttagtacataaggccaccacaatgctcaagaaattattttagaaaaaacgtacgagttacatttagtgcaagttgaccttatgcccatgcctccatacatggactggttctgttttattaaaactaatatttcatacagatta

SEQ ID NO: 172614 - DNA, 7366 bp, Homo sapiens
  Payload ID: 13940
  Gene Symbol: PDXK
  Gene Name: pyridoxal (pyridoxine, vitamin B6) kinase
  Uniprot ID: O00764
  ENST ID: ENST00000291565
  CDS Start-End: 184-1122
cggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctgccttgatttcagccacacccctgcagccctgcatcccagctctggggtgtgcagaggtttgtgtctccagggaacccacggctggagagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttcttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcctgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgtaaggatgaattccacaataggatcctttttaaaatcgattttaaattgttgcctagtcctgccaaggttattatgtgcatctgttatttttccaatacatgtaaacagttgcagcatgatgctttgtttaatgtcctgttcttaagctcgttagagccagttttgaaacgtttggtcttaccgtgaacggaggctggcttggcttagccacgctgatgagtaagtgagggatgtctccatcttgagatcaccaggcaagagagttgcctgcaccaggtaagaggccaaagcccctggggtaacagtccccaccgctacccgaggtaaaacaataaaagctatgtggttgagctcaggcctctcgtgcctggtgtcagagaaggcagagcccacagtaggtgcacggtgcaaggccctgggagggcactggccagggaaggtggtatagatggccctcagattgcggggccccgagcagctccccactctgcccgtccaccttccctggctccagcctcattctctctttagtttaactatgcaaagagaggaggttgagagtgttctggcagctggagctcttttccttgtccttcctgccctccgatggggccacctgtgtcggggcagcagtgtccatgtttatggagatcagaggtgtccccactgtgtggctggactgtactctgctgcccgggtagccaggagtctctccctctctcccctgccgcctgcctggtctcatgggcctccttcacacacccctccctgtggatcgcctgcctgggcccagagcaggggaactggagtttgtgagtgagcagagcaggttatgtgcagacagggaaacgagaactttggacctggctttctgagtccaggtgagagctgtgtggccccccgatgccactctgcccgccggagggatgtgcctgctgagccttttccttccacgccgcctctcactgccaggccagcggcttccgctgagactcgctggagaggcggctcccgtgtccgtccaccgagcactcagatggatgctgatcaccagggccgagggggctcccagaaggaccccaggccctggggagggtggctgtgggaggccaagtccactgcccggaagtcttgtcagccctaagccagggaagcctggagcgtggcctggcgggtctgggtggacaccgtccccactccggactcccagcacaggggaggatacctgagcctgtatggccctgtagccctgggcagagctgggcctgtcgtgtgttcctgcctggcaggtgcaggtgctggccatctgcaggtggaaggaggtgggaatcttggattttttgtttttttttgtttttttttttttgaggtgaagtctcgctctgacacccaggctggcgtgcagtggtgtgatctcggctcactgcaaactccgcttcctgggttcaagtggttctcctgccccagcctcccaagtagctgggattacaggcatgcgccaccacgctcagctgatttttgtatttttagtagagatggggtttcaccatgttggccaagctggtctcaaactcctgacctcaagtgatctgcccgcctcggcctcccagagtgctgggattacaggcatgagccagtgcacccggcggaatcttggaatttttatagacagcacctcagtttctgactccagccgcacacctcctgcctctgccagcaggggttgccgccagaccagagccagggccaggtccctgcgtccatcccccccggtaggatggacgtgagccatccttctaggggacttttttcagtgtgcgactcgtctctgttaggtggtaggagccagtttgtgtggcctgtgccacgctccacagtgcgtggctgggctctgtgtgtggcctgtgtcccctgtccctgcaggacccagcaggcatcgtggcgtgacagctgtgtccaagccactgcccgggcatcccatcacccaccagggtgcacggtctctcctgctgggggctttctgtcgcatgtgtgtctcctgtcgactctgcagtttgttctcagagcagaatgtttcctgttctcagtgcacaaagacactggttttcaatcggcgtctaaaaccacgttcctgcctttcattgcaacacggtgtgttcatttgtttaaaacagtttaatgagtaagtttagatgactggtcaatatcttaaaaatgtatattagtaagaagttcttcctggaatttttctttcgattctggcagaataaacaggtgtttttagttttcccactgtctgagccaagcaggaccctgtcccagagcaagagatgtccccttccatctctgacccttgcctgggacaagctttgatggggggccccagcttcaaggctgtggtgggaacagcacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcggataggtgggtgggaacagagaggggagaatgccgtcctaagcttctgcttggggatcccccacacgacctgggtactgcctgggaaacctgtcctaagtaaaactatggacctcgcctcgcccaccggcctgcgaagccagcatctccgtgaaggtggatggaagcgcctttgtcctcattttgagctgcaagctgggtcagcggctctgaagccctcgagtgactttctaacccaagacccagcccctggcaggaggagggtgggtgcagggctggtgggacaaaaagaggcctcagcaggcctggaagacccttccagtacatcccacagcgtgtcgagcagctgggagaacctgtgtcaagctcgagccgtcataggtccccatgaggtgtctgaagccccttcttggtgatgggaggcagaggtgctgacgttctggagcatggacgtgagtcctcagctggctccgcgtgggcccttggagggtgccaggtgtgtggtgaccttctggatgcctttaacttcatggctgcgtcattcctgatttagaactttaaccggagcttcatctagtgattgcaaaactggaccaatgggaggacggcggcgcagcccgctccctccgtggaatggagctcagctcttcggaggcatcaaagcacctgtcgcctccgtggtccccctgctgagggagtgcggcctctgcaaggttcgggggtggcttcgtttgcctggagtggccggccctgcttgtgccatgtggatgtttgtgagcctcggtcctacagcactgtgtaggctgcatctgtttcgtgctggtcctgttgacttgtatgatatccacaaataaatattttcatggcggtcgtgttga

SEQ ID NO: 172615 - DNA, 2583 bp, Homo sapiens
  Payload ID: 13940
  Gene Symbol: PDXK
  Gene Name: pyridoxal (pyridoxine, vitamin B6) kinase
  ENST ID: ENST00000327574
  CDS Start-End: 351-797
aagccatcccactggcctggactctgctgggattattttgaccccccagggcagagtgtagccatctgactggctttctctctcggcaggagacggggcgcacgcctgcaggcttcagtttcacattcttggtacctcctggtggtgcctgggagggagccactgctgtacagagatgccaattccagaggcatggtccggcacagagcgctggcttccagctgaaggacatgtgtaacagcaggagatacctttctctggggtcccaggctcccgtcctggaccttggcaccccgccccccgtgcattgtcgtcttctgagtctggctttgtctggcacatgaagttggatgggtagactctggaagcgtccagaccagcttgcgatgctgatgaataagctgattttgatggggtgtgtgaaacggagatgccagcccaggggctcagcttgctcgtgctctcatttaaaagcagaaaatagcgacttcattctcggatacgtttgccagccccaaaggattaattatctacacacccagaagcagtggagcagaatattttggcaggattttcaggatttgtgtcatcgttgcttaatatctgtttcttcacagtcggttttgggatttgagattgacgcggtgaactctgtccagttttcaaaccacacagagacaaggtcggtctctgtcgcccaggctggcgtgaagtggcgcaaccagctcactgcagccttgacctcctgggctgaagcaatctttctgcctccacctcccgagtggctgggactatagttgtgcaccagcacgcccacctcctgcccagggttgttactggggtggtcacgtgggcagcttctgcctgggatgggccacaaagccagactcccggcagggacacgggtgttccacacaagctgcgttgttggttccctgacgcccttcaggctggggggtgggaaagccgatcccccaagtgcctgcagagcccacctggcgcaggcctcgccgcctcgaggctgctgctcgcacttctgccccttcccccggccaggcccccgttccttgaggccgtaccacaaggtgcgttcatttttccacaccgtgagctgggcttggcagagcctccaccttgtggccagtattcccagtggcccctttgagaggatttcctggagctccctgtctgagcttcccggactgagggcactgggaaggagcctgcggagctggaggtcagcgggtggacgggttgcgctgtcctggctttcggagtgtagagccagaggggatgggacaggtgccctgctgctgggcttggtggtccctgctgcagggaaggggcagctggtgtgaacacaaggagctgcggggctggagaaggccagggccaggagcctgccgacggacaccagcgaggggccaggccgggccaggagcctgccgacggacaccagcgaggggccaggccgggccagactccctggccggctgggatctgacaggagtgccaggctccttgggccgcccgaggaaccgcttgtttgcctgtgctttttcatctgtaaatggaatgagttggacacaagatccaagcgccctcccctgttggagaaggttcttgtgggctctgggcccatcccacatcccacagtgggcaggaggccaccaagaggtgcaagaccatgccctctgtttcgataggaagctgggcctcagaggggcctggggcctgtgtctgagacccggccaagtgctggacgtctccccttcctcatggctgttatggctgaattacgtccccccaaattctcatgttgcagccttaaccccagcacctcagtgtgggactgggtttggagatggagcccctacagaggtcagcaggttaaaagaggccatcagggctctgggtgggccctgatccaagctgcttggtgtccttgtaagaagaagagatgaggacacagacacacacagagggacagccccatgaggaaacagggaggcaatgccgtctgcaagcccagggcagaggcctcaggaaccagccctggtgacacctggaccttggacccccgtgcccaggacagtaggagaattggagccgcctggctgcagtccttcccgatggcaccctgtattagtccgttctcacactgctaattgttgggaaaagggcttgtggaatgcctgtataaactggccatgaaaatatgggacaataagttgtggaaagccacaagaggcctctgaggaggaaagcctcctaattgccatcatgttcgcatgctcagggcgagacctgctgtcttatctgtaaacaccgtgttcaaggagaaagacattccttcgaagcactggactgtggacagacacacgagctcctggttaagcccgctcccaccagctcctgtccgataagttaaagatacgctgtttgagcacaaaggagattcattgaaaccgctattgctgtagattacgcctgtgacgcactgcctccctttcactgtttcgccctgaatatctgcttctcagatctaagtgactgtactcaataaatagcgtggagaccaga

SEQ ID NO: 172616 - DNA, 2251 bp, Homo sapiens
  Payload ID: 13940
  Gene Symbol: PDXK
  Gene Name: pyridoxal (pyridoxine, vitamin B6) kinase
  ENST ID: ENST00000398081
  CDS Start-End: 202-465
gcgcggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacagagacaaggtcggtctctgtcgcccaggctggcgtgaagtggcgcaaccagctcactgcagccttgacctcctgggctgaagcaatctttctgcctccacctcccgagtggctgggactatagttgtgcaccagcacgcccacctcctgcccagggttgttactggggtggtcacgtgggcagcttctgcctgggatgggccacaaagccagactcccggcagggacacgggtgttccacacaagctgcgttgttggttccctgacgcccttcaggctggggggtgggaaagccgatcccccaagtgcctgcagagcccacctggcgcaggcctcgccgcctcgaggctgctgctcgcacttctgccccttcccccggccaggcccccgttccttgaggccgtaccacaaggtgcgttcatttttccacaccgtgagctgggcttggcagagcctccaccttgtggccagtattcccagtggcccctttgagaggatttcctggagctccctgtctgagcttcccggactgagggcactgggaaggagcctgcggagctggaggtcagcgggtggacgggttgcgctgtcctggctttcggagtgtagagccagaggggatgggacaggtgccctgctgctgggcttggtggtccctgctgcagggaaggggcagctggtgtgaacacaaggagctgcggggctggagaaggccagggccaggagcctgccgacggacaccagcgaggggccaggccgggccaggagcctgccgacggacaccagcgaggggccaggccgggccagactccctggccggctgggatctgacaggagtgccaggctccttgggccgcccgaggaaccgcttgtttgcctgtgctttttcatctgtaaatggaatgagttggacacaagatccaagcgccctcccctgttggagaaggttcttgtgggctctgggcccatcccacatcccacagtgggcaggaggccaccaagaggtgcaagaccatgccctctgtttcgataggaagctgggcctcagaggggcctggggcctgtgtctgagacccggccaagtgctggacgtctccccttcctcatggctgttatggctgaattacgtccccccaaattctcatgttgcagccttaaccccagcacctcagtgtgggactgggtttggagatggagcccctacagaggtcagcaggttaaaagaggccatcagggctctgggtgggccctgatccaagctgcttggtgtccttgtaagaagaagagatgaggacacagacacacacagagggacagccccatgaggaaacagggaggcaatgccgtctgcaagcccagggcagaggcctcaggaaccagccctggtgacacctggaccttggacccccgtgcccaggacagtaggagaattggagccgcctggctgcagtccttcccgatggcaccctgtattagtccgttctcacactgctaattgttgggaaaagggcttgtggaatgcctgtataaactggccatgaaaatatgggacaataagttgtggaaagccacaagaggcctctgaggaggaaagcctcctaattgccatcatgttcgcatgctcagggcgagacctgctgtcttatctgtaaacaccgtgttcaaggagaaagacattccttcgaagcactggactgtggacagacacacgagctcctggttaagcccgctcccaccagctcctgtccgataagttaaagatacgctgtttgagcacaaaggagattcattgaaaccgctattgctgtagattacgcctgtgacgcactgcctccctttcactgtttcgccctgaatatctgcttctcagatctaagtgactgtactcaataaatagcgtggagaccaga

SEQ ID NO: 172617 - DNA, 7297 bp, Homo sapiens
  Payload ID: 13940
  Gene Symbol: PDXK
  Gene Name: pyridoxal (pyridoxine, vitamin B6) kinase
  Uniprot ID: O00764
  ENST ID: ENST00000468090
  CDS Start-End: 199-1053
cggaactcgcgggttcggagccgcccgctgaggtcagaaggaggcgtctgcgctgatcgggtccgccgcgcgccagagccagagtcgcagccgaggggagccggggccggagcccgagcccgagccgagccggagcccgagcgagcggcggagaccgtgcccccgcctcggccccgcgccgccgcggccaggcccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacagtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctgccttgatttcagccacacccctgcagccctgcatcccagctctggggtgtgcagaggtttgtgtctccagggaacccacggctggagagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttcttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcctgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgtaaggatgaattccacaataggatcctttttaaaatcgattttaaattgttgcctagtcctgccaaggttattatgtgcatctgttatttttccaatacatgtaaacagttgcagcatgatgctttgtttaatgtcctgttcttaagctcgttagagccagttttgaaacgtttggtcttaccgtgaacggaggctggcttggcttagccacgctgatgagtaagtgagggatgtctccatcttgagatcaccaggcaagagagttgcctgcaccaggtaagaggccaaagcccctggggtaacagtccccaccgctacccgaggtaaaacaataaaagctatgtggttgagctcaggcctctcgtgcctggtgtcagagaaggcagagcccacagtaggtgcacggtgcaaggccctgggagggcactggccagggaaggtggtatagatggccctcagattgcggggccccgagcagctccccactctgcccgtccaccttccctggctccagcctcattctctctttagtttaactatgcaaagagaggaggttgagagtgttctggcagctggagctcttttccttgtccttcctgccctccgatggggccacctgtgtcggggcagcagtgtccatgtttatggagatcagaggtgtccccactgtgtggctggactgtactctgctgcccgggtagccaggagtctctccctctctcccctgccgcctgcctggtctcatgggcctccttcacacacccctccctgtggatcgcctgcctgggcccagagcaggggaactggagtttgtgagtgagcagagcaggttatgtgcagacagggaaacgagaactttggacctggctttctgagtccaggtgagagctgtgtggccccccgatgccactctgcccgccggagggatgtgcctgctgagccttttccttccacgccgcctctcactgccaggccagcggcttccgctgagactcgctggagaggcggctcccgtgtccgtccaccgagcactcagatggatgctgatcaccagggccgagggggctcccagaaggaccccaggccctggggagggtggctgtgggaggccaagtccactgcccggaagtcttgtcagccctaagccagggaagcctggagcgtggcctggcgggtctgggtggacaccgtccccactccggactcccagcacaggggaggatacctgagcctgtatggccctgtagccctgggcagagctgggcctgtcgtgtgttcctgcctggcaggtgcaggtgctggccatctgcaggtggaaggaggtgggaatcttggattttttgtttttttttgtttttttttttttgaggtgaagtctcgctctgacacccaggctggcgtgcagtggtgtgatctcggctcactgcaaactccgcttcctgggttcaagtggttctcctgccccagcctcccaagtagctgggattacaggcatgcgccaccacgctcagctgatttttgtatttttagtagagatggggtttcaccatgttggccaagctggtctcaaactcctgacctcaagtgatctgcccgcctcggcctcccagagtgctgggattacaggcatgagccagtgcacccggcggaatcttggaatttttatagacagcacctcagtttctgactccagccgcacacctcctgcctctgccagcaggggttgccgccagaccagagccagggccaggtccctgcgtccatcccccccggtaggatggacgtgagccatccttctaggggacttttttcagtgtgcgactcgtctctgttaggtggtaggagccagtttgtgtggcctgtgccacgctccacagtgcgtggctgggctctgtgtgtggcctgtgtcccctgtccctgcaggacccagcaggcatcgtggcgtgacagctgtgtccaagccactgcccgggcatcccatcacccaccagggtgcacggtctctcctgctgggggctttctgtcgcatgtgtgtctcctgtcgactctgcagtttgttctcagagcagaatgtttcctgttctcagtgcacaaagacactggttttcaatcggcgtctaaaaccacgttcctgcctttcattgcaacacggtgtgttcatttgtttaaaacagtttaatgagtaagtttagatgactggtcaatatcttaaaaatgtatattagtaagaagttcttcctggaatttttctttcgattctggcagaataaacaggtgtttttagttttcccactgtctgagccaagcaggaccctgtcccagagcaagagatgtccccttccatctctgacccttgcctgggacaagctttgatggggggccccagcttcaaggctgtggtgggaacagcacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcggataggtgggtgggaacagagaggggagaatgccgtcctaagcttctgcttggggatcccccacacgacctgggtactgcctgggaaacctgtcctaagtaaaactatggacctcgcctcgcccaccggcctgcgaagccagcatctccgtgaaggtggatggaagcgcctttgtcctcattttgagctgcaagctgggtcagcggctctgaagccctcgagtgactttctaacccaagacccagcccctggcaggaggagggtgggtgcagggctggtgggacaaaaagaggcctcagcaggcctggaagacccttccagtacatcccacagcgtgtcgagcagctgggagaacctgtgtcaagctcgagccgtcataggtccccatgaggtgtctgaagccccttcttggtgatgggaggcagaggtgctgacgttctggagcatggacgtgagtcctcagctggctccgcgtgggcccttggagggtgccaggtgtgtggtgaccttctggatgcctttaacttcatggctgcgtcattcctgatttagaactttaaccggagcttcatctagtgattgcaaaactggaccaatgggaggacggcggcgcagcccgctccctccgtggaatggagctcagctcttcggaggcatcaaagcacctgtcgcctccgtggtccccctgctgagggagtgcggcctctgcaaggttcgggggtggcttcgtttgcctggagtggccggccctgcttgtgccatgtggatgtttgtgagcctcggtcctacagcactgtgtaggctgcatctgtttcgtgctggtcctgttgacttgtatgatatccacaaataaatattttcatggcggtcgtgttga

SEQ ID NO: 172618 - DNA, 7194 bp, Homo sapiens
  Payload ID: 13940
  Gene Symbol: PDXK
  Gene Name: pyridoxal (pyridoxine, vitamin B6) kinase
  ENST ID: ENST00000467908
  CDS Start-End: 132-950
ggggggctcgcggggggctcgcgggggggctcgcggggggctcgcggggggctcgaggcgtcccatgtgggcagccgttgggacctgccaagcactgcgcctagtgatctccttcgggtttgagccagtccatggggaggagccgtccaccaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttgcccgtgacacgcagcgcgttggtgtctccgtgtttgtccctgtgaaaacatgtaacgtctgccttagagccatgaccgaaacttgatatttttttctttcatgagtgtccggcatctgctggtcttcattgtgaaacgtgccagtcgtgctttgtgaaaaataacaaagtggtcacagaaatttgtgatctgaaaacccggctcccttccccacaaggctcctgggcctccgggaagacgggcccctgtttgccatctcgggggtgttccctgtgggagggtgagtgggtgaggccgagcctgctgcgtgtggagcctcgagtgggccctggctgccactaccgtacagaggccgtgtcgcgctgggctgggcctgggtggcctctgtctttgcatctctgagaaggagtcgggtggtaacggttggggtcaggaagaattctgccaagtatctttactgtcattctgaccatagcctctttgttcccgcattcgaacttttggttcttactttgctgctcgtttagtccctggggatttcagatcttaggctgttgtttcaccgtatgggagggttgatgtgagcttgcttggagacacacggtgcagcatcagggaccttcccaggccccagcaaattcaagtcggtctgcagacctctcagctacccgcgggacctcttgtaacccatcggcatcttccaggaatccgccgagtgacttgaggaagatgctaacgcagtaaggtctgtgctgggccaagagcagctttgaagctccagagaaccaccccgtcaggttccttgtggaagctcccctcatccgtggtgcagcaggctgagcactgcgcgtttgccacgtgctgcccgtgacagcacattgagccacagcatttgtagacaggacagaggggtgcctgccccctgcccctgctggcacatttaacccttgtcccctgacctcagttctgtgccccaccaaatgcccaggggcaagaggccaccctggaagctgccaatcttccaaggtgggtgtggggcacggtgggggcgggcagctcccaggcccttgggcaggctggggtgacggcagaggccacagcaccagctctgacaagtcctatcatcctctgctcagcagtgacctccctggccccactttgcccagagtttggggtccccccaggtatagctataggcggcagtgcctgtccctggcctgccttgatttcagccacacccctgcagccctgcatcccagctctggggtgtgcagaggtttgtgtctccagggaacccacggctggagagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttcttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcctgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgtaaggatgaattccacaataggatcctttttaaaatcgattttaaattgttgcctagtcctgccaaggttattatgtgcatctgttatttttccaatacatgtaaacagttgcagcatgatgctttgtttaatgtcctgttcttaagctcgttagagccagttttgaaacgtttggtcttaccgtgaacggaggctggcttggcttagccacgctgatgagtaagtgagggatgtctccatcttgagatcaccaggcaagagagttgcctgcaccaggtaagaggccaaagcccctggggtaacagtccccaccgctacccgaggtaaaacaataaaagctatgtggttgagctcaggcctctcgtgcctggtgtcagagaaggcagagcccacagtaggtgcacggtgcaaggccctgggagggcactggccagggaaggtggtatagatggccctcagattgcggggccccgagcagctccccactctgcccgtccaccttccctggctccagcctcattctctctttagtttaactatgcaaagagaggaggttgagagtgttctggcagctggagctcttttccttgtccttcctgccctccgatggggccacctgtgtcggggcagcagtgtccatgtttatggagatcagaggtgtccccactgtgtggctggactgtactctgctgcccgggtagccaggagtctctccctctctcccctgccgcctgcctggtctcatgggcctccttcacacacccctccctgtggatcgcctgcctgggcccagagcaggggaactggagtttgtgagtgagcagagcaggttatgtgcagacagggaaacgagaactttggacctggctttctgagtccaggtgagagctgtgtggccccccgatgccactctgcccgccggagggatgtgcctgctgagccttttccttccacgccgcctctcactgccaggccagcggcttccgctgagactcgctggagaggcggctcccgtgtccgtccaccgagcactcagatggatgctgatcaccagggccgagggggctcccagaaggaccccaggccctggggagggtggctgtgggaggccaagtccactgcccggaagtcttgtcagccctaagccagggaagcctggagcgtggcctggcgggtctgggtggacaccgtccccactccggactcccagcacaggggaggatacctgagcctgtatggccctgtagccctgggcagagctgggcctgtcgtgtgttcctgcctggcaggtgcaggtgctggccatctgcaggtggaaggaggtgggaatcttggattttttgtttttttttgtttttttttttttgaggtgaagtctcgctctgacacccaggctggcgtgcagtggtgtgatctcggctcactgcaaactccgcttcctgggttcaagtggttctcctgccccagcctcccaagtagctgggattacaggcatgcgccaccacgctcagctgatttttgtatttttagtagagatggggtttcaccatgttggccaagctggtctcaaactcctgacctcaagtgatctgcccgcctcggcctcccagagtgctgggattacaggcatgagccagtgcacccggcggaatcttggaatttttatagacagcacctcagtttctgactccagccgcacacctcctgcctctgccagcaggggttgccgccagaccagagccagggccaggtccctgcgtccatcccccccggtaggatggacgtgagccatccttctaggggacttttttcagtgtgcgactcgtctctgttaggtggtaggagccagtttgtgtggcctgtgccacgctccacagtgcgtggctgggctctgtgtgtggcctgtgtcccctgtccctgcaggacccagcaggcatcgtggcgtgacagctgtgtccaagccactgcccgggcatcccatcacccaccagggtgcacggtctctcctgctgggggctttctgtcgcatgtgtgtctcctgtcgactctgcagtttgttctcagagcagaatgtttcctgttctcagtgcacaaagacactggttttcaatcggcgtctaaaaccacgttcctgcctttcattgcaacacggtgtgttcatttgtttaaaacagtttaatgagtaagtttagatgactggtcaatatcttaaaaatgtatattagtaagaagttcttcctggaatttttctttcgattctggcagaataaacaggtgtttttagttttcccactgtctgagccaagcaggaccctgtcccagagcaagagatgtccccttccatctctgacccttgcctgggacaagctttgatggggggccccagcttcaaggctgtggtgggaacagcacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcggataggtgggtgggaacagagaggggagaatgccgtcctaagcttctgcttggggatcccccacacgacctgggtactgcctgggaaacctgtcctaagtaaaactatggacctcgcctcgcccaccggcctgcgaagccagcatctccgtgaaggtggatggaagcgcctttgtcctcattttgagctgcaagctgggtcagcggctctgaagccctcgagtgactttctaacccaagacccagcccctggcaggaggagggtgggtgcagggctggtgggacaaaaagaggcctcagcaggcctggaagacccttccagtacatcccacagcgtgtcgagcagctgggagaacctgtgtcaagctcgagccgtcataggtccccatgaggtgtctgaagccccttcttggtgatgggaggcagaggtgctgacgttctggagcatggacgtgagtcctcagctggctccgcgtgggcccttggagggtgccaggtgtgtggtgaccttctggatgcctttaacttcatggctgcgtcattcctgatttagaactttaaccggagcttcatctagtgattgcaaaactggaccaatgggaggacggcggcgcagcccgctccctccgtggaatggagctcagctcttcggaggcatcaaagcacctgtcgcctccgtggtccccctgctgagggagtgcggcctctgcaaggttcgggggtggcttcgtttgcctggagtggccggccctgcttgtgccatgtggatgtttgtgagcctcggtcctacagcactgtgtaggctgcatctgtttcgtgctggtcctgttgacttgtatgatatccacaaataaatattttcatggcggtcgtgttga

SEQ ID NO: 172619 - DNA, 1967 bp, Homo sapiens
  Payload ID: 13940
  Gene Symbol: PDXK
  Gene Name: pyridoxal (pyridoxine, vitamin B6) kinase
  ENST ID: ENST00000621478
  CDS Start-End: 257-745
cttgcaggttttgggatttgagattgacgcggtgaactctgtccagttttcaaaccacacagagacaaggtcggtctctgtcgcccaggctggcgtgaagtggcgcaaccagctcactgcagccttgacctcctgggctgaagcaatctttctgcctccacctcccgagtggctgggactatagttgtgcaccagcacgcccacctcctgcccagggttgttactggggtggtcacgtgggcagcttctgcctgggatgggccacaaagccagactcccggcagggacacgggtgttccacacaagctgcgttgttggttccctgacgcccttcaggctggggggtgggaaagccgatcccccaagtgcctgcagagcccacctggcgcaggcctcgccgcctcgaggctgctgctcgcacttctgccccttcccccggccaggcccccgttccttgaggccgtaccacaaggtgcgttcatttttccacaccgtgagctgggcttggcagagcctccaccttgtggccagtattcccagtggcccctttgagaggatttcctggagctccctgtctgagcttcccggactgagggcactgggaaggagcctgcggagctggaggtcagcgggtggacgggttgcgctgtcctggctttcggagtgtagagccagaggggatgggacaggtgccctgctgctgggcttggtggtccctgctgcagggaaggggcagctggtgtgaacacaaggagctgcggggctggagaaggccagggccaggagcctgccgacggacaccagcgaggggccaggccgggccaggagcctgccgacggacaccagcgaggggccaggccgggccagactccctggccggctgggatctgacaggagtgccaggctccttgggccgcccgaggaaccgcttgtttgcctgtgctttttcatctgtaaatggaatgagttggacacaagatccaagcgccctcccctgttggagaaggttcttgtgggctctgggcccatcccacatcccacagtgggcaggaggccaccaagaggtgcaagaccatgccctctgtttcgataggaagctgggcctcagaggggcctggggcctgtgtctgagacccggccaagtgctggacgtctccccttcctcatggctgttatggctgaattacgtccccccaaattctcatgttgcagccttaaccccagcacctcagtgtgggactgggtttggagatggagcccctacagaggtcagcaggttaaaagaggccatcagggctctgggtgggccctgatccaagctgcttggtgtccttgtaagaagaagagatgaggacacagacacacacagagggacagccccatgaggaaacagggaggcaatgccgtctgcaagcccagggcagaggcctcaggaaccagccctggtgacacctggaccttggacccccgtgcccaggacagtaggagaattggagccgcctggctgcagtccttcccgatggcaccctgtattagtccgttctcacactgctaattgttgggaaaagggcttgtggaatgcctgtataaactggccatgaaaatatgggacaataagttgtggaaagccacaagaggcctctgaggaggaaagcctcctaattgccatcatgttcgcatgctcagggcgagacctgctgtcttatctgtaaacaccgtgttcaaggagaaagacattccttcgaagcactggactgtggacagacacacgagctcctggttaagcccgctcccaccagctcctgtccgataagttaaagatacgctgtttgagcacaaaggagattcattgaaaccgctattgctgtagattacgcctgtgacgcactgcctccctttcactgtttcgccctgaatatctgcttctcagatctaagtgactgtactcaataaatagcgtggagacc

SEQ ID NO: 172620 - DNA, 2010 bp, Homo sapiens
  Payload ID: 13941
  Gene Symbol: PDXP
  Gene Name: pyridoxal (pyridoxine, vitamin B6) phosphatase
  Uniprot ID: Q96GD0
  ENST ID: ENST00000215904
  CDS Start-End: 57-947
gcgcgccgtgcccgcggagagagcgcggcgcgggaggccggcggccggccggctgcatggcgcgctgcgagaggctgcgcggagcggccctgcgcgacgtgctgggccgggcgcagggggtcctgttcgactgtgacggggtgctgtggaacggcgagcgcgccgtgccgggcgccccggagctgctggagcggctggcgcgggccggcaaggcggctctgtttgtgagcaacaacagccggcgcgcgcggcccgagctggccctgcgcttcgcgcgcctcggcttcggggggctgcgcgccgagcagctcttcagctccgcgctgtgcgccgcgcgcctgctgcgccagcgcctgcccgggcctccggacgcgccgggcgccgtgttcgtgctgggcggcgaggggctgcgcgccgagctgcgcgccgcggggctgcgcctggccggggacccgagcgcgggggacggcgcggccccgcgcgtgcgcgccgtgcttgtgggctacgacgagcacttctccttcgccaagctgagggaggcgtgcgcgcacctgcgcgaccccgagtgcctactcgtggccaccgaccgtgacccatggcacccgctgagcgacggcagccggacccctggcaccgggagcctggccgctgcagtggagacagcctcgggacgccaggccctggtggtgggcaagcccagcccctacatgttcgagtgcatcacggagaacttcagcatcgaccccgcacgcacgcttatggtgggtgaccgcctggagaccgacatcctctttggccaccgctgcggcatgaccactgtgctcacgctcacaggagtctcccgcctagaagaggcccaggcctacctagcggccggccagcacgacctcgtgccccattactatgtggagagcatcgcagacttgacagaggggttggaggactgagcccactgcacctgcagccacaggcccacccctccccactccctgatcccgtaggtggaggcgatgggtcacgagccatgttaagcacaaccggctccttggtccagttctgcaccggggtggggctgggacccggggaaggtttgagggcccttgcaaccccctcccagcagtggctgggcactctttgctgccccagaagctggtcccctatggattcatcttggcctgacccagccaggtggccttatttcttccctgtcacctcccctccttgaaatctgggccctggtgcctgctgaagattccctctatccctgagtacttagtcttctcccccttccctggggcttctagagctctctctgcccctcaggtcctggcccttgggtccttgtcaaccagaggtctagggaaccacaacccttattgtcctgggtggaccaatccaaaggctaagtgatagtgactcatcaatgttgggtcctgtggggtaccagtttaggttcctaagtaatagtgaccctttcacgtcctggagcccgagtggaccaatcggaagcctaagtgacgatgaccctcgcatgtcctaggtccctgggtggacccatcaggaccccaagtgatagtgacccagtggtcttttagatcctcagtagaacagtccagaagcctgagagacagtggccccttgataatctgggtctcacgggaccagctaggggtccaggtttcagtcagtaaataagagtggtccacgtcctaaagacacctctcctttacaaagacttgtgatgctctggggcttctgtggccaagccccaccctttcctggtcatggtacccgtacagcgttgatggccacagctcgaaggggggctttcgtgtccccctgtgcggtcagtgttttcagtaccacctctctcccgtgcccacttggctatttacttatttatttattgtgtgccagtgatggtgggtgggggctgggccttccccgccacctccacccctgttgtgacctgtccttccgtacttaataaagtgcgcgtgggagtgttca

SEQ ID NO: 172621 - DNA, 1571 bp, Homo sapiens
  Payload ID: 13941
  Gene Symbol: PDXP
  Gene Name: pyridoxal (pyridoxine, vitamin B6) phosphatase
  ENST ID: ENST00000403251
  CDS Start-End: 271-510
atcactttcccgggggacgcggactgggtcagaggtgcgaacatttctgtgccccgctgtgttccaaaggggctgtgccagtttctaacgccagccgcgtgaattcctgcagcagtaaccacaactgctatttgttaagtgctgttccatttacaaagcacttgcccctgtgttgcccagcgcccgtttggaggcaccgggagcctggccgctgcagtggagacagcctcgggacgccaggccctggtggtgggcaagcccagcccctacatgttcgagtgcatcacggagaacttcagcatcgaccccgcacgcacgcttatggtgggtgaccgcctggagaccgacatcctctttggccaccgctgcggcatgaccactgtgctcacgctcacaggagtctcccgcctagaagaggcccaggcctacctagcggccggccagcacgacctcgtgccccattactatgtggagagcatcgcagacttgacagaggggttggaggactgagcccactgcacctgcagccacaggcccacccctccccactccctgatcccgtaggtggaggcgatgggtcacgagccatgttaagcacaaccggctccttggtccagttctgcaccggggtggggctgggacccggggaaggtttgagggcccttgcaaccccctcccagcagtggctgggcactctttgctgccccagaagctggtcccctatggattcatcttggcctgacccagccaggtggccttatttcttccctgtcacctcccctccttgaaatctgggccctggtgcctgctgaagattccctctatccctgagtacttagtcttctcccccttccctggggcttctagagctctctctgcccctcaggtcctggcccttgggtccttgtcaaccagaggtctagggaaccacaacccttattgtcctgggtggaccaatccaaaggctaagtgatagtgactcatcaatgttgggtcctgtggggtaccagtttaggttcctaagtaatagtgaccctttcacgtcctggagcccgagtggaccaatcggaagcctaagtgacgatgaccctcgcatgtcctaggtccctgggtggacccatcaggaccccaagtgatagtgacccagtggtcttttagatcctcagtagaacagtccagaagcctgagagacagtggccccttgataatctgggtctcacgggaccagctaggggtccaggtttcagtcagtaaataagagtggtccacgtcctaaagacacctctcctttacaaagacttgtgatgctctggggcttctgtggccaagccccaccctttcctggtcatggtacccgtacagcgttgatggccacagctcgaaggggggctttcgtgtccccctgtgcggtcagtgttttcagtaccacctctctcccgtgcccacttggctatttacttatttatttattgtgtgccagtgatggtgggtgggggctgggccttccccgccacctccacccctgttgtgacctgtccttccgtacttaataaagtgcgcgtgggagtgtt

SEQ ID NO: 172622 - DNA, 1113 bp, Homo sapiens
  Payload ID: 13942
  Gene Symbol: PDXDC1
  Gene Name: pyridoxal-dependent decarboxylase domain containing 1
  ENST ID: ENST00000325823
  CDS Start-End: 1-1113
atggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcagaaagtttga

SEQ ID NO: 172623 - DNA, 4521 bp, Homo sapiens
  Payload ID: 13942
  Gene Symbol: PDXDC1
  Gene Name: pyridoxal-dependent decarboxylase domain containing 1
  Uniprot ID: Q6P996
  ENST ID: ENST00000396410
  CDS Start-End: 98-2464
cgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaccagtgaattcagtttataaatcttattacaaaagacttacccacgtacctgaaatagctgccgatagaccagtgagaggtaggttctcctctgcccgttattaccgaccaaaaaaaaaactggacatcaattttttagtaaaccaaaaaataagtctcaacaaatgcctttgccaaaataaggttttattttgaaagtcatttgatgaaagtcatttgaaagacactgaggagggaaggaggcctaagacccaacagatgtaggatccagatctggattcgtgccagccccaccaatggtctgtcaggccaagaaggtgctttctttggtaattcatgttttttaacttcctggagaagagatcttttcccacaagccatcttcattttttttgtagagtagggctttatttccagaaaacagtgtgtgagctggagatgggtgtttttttaaaaacatcaaggtagatctaatatgttcaacaaagtggggtggctcagccagaggcgaagtggaaagattctgaaaacacaagatggtgggcattagagaagccaaccttactgtcccctgctgtgataaagatgtcaaagtatctttgttcttggacacaaatatatataataaaatacgttaagaaatga

SEQ ID NO: 172624 - DNA, 4171 bp, Homo sapiens
  Payload ID: 13942
  Gene Symbol: PDXDC1
  Gene Name: pyridoxal-dependent decarboxylase domain containing 1
  Uniprot ID: Q6P996
  ENST ID: ENST00000450288
  CDS Start-End: 30-2123
cccagatagcagaccccacgttagctgaaatgggaaaaaacttgaaggaggcagtgaagatgctggaggacagtcagagaagaacagaagaggaaaatggaaagaagctcatatccggagatattccaggcccactccagggcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaccagtgaattcagtttataaatcttattacaaaagacttacccacgtacctgaaatagctgccgatagaccagtgagaggtaggttctcctctgcccgttattaccgaccaaaaaaaaaactggacatcaattttttagtaaaccaaaaaataagtctcaacaaatgcctttgccaaaataaggttttattttgaaagtcatttgatgaaagtcatttgaaagacactgaggagggaaggaggcctaagacccaacagatgtaggatccagatctggattcgtgccagccccaccaatggtctgtcaggccaagaaggtgctttctttggtaattcatgttttttaacttcctggagaagagatcttttcccacaagccatcttcattttttttgtagagtagggctttatttccagaaaacagtgtgtgagctggagatgggtgtttttttaaaaacatcaaggtagatctaatatgttcaacaaagtggggtggctcagccagaggcgaagtggaaagattctgaaaacacaagatggtgggcattagagaagccaaccttactgtcccctgctgtgataaagatgtcaaagtatctttgttcttggacacaaatatatataataaaatacgtt

SEQ ID NO: 172625 - DNA, 2183 bp, Homo sapiens
  Payload ID: 13942
  Gene Symbol: PDXDC1
  Gene Name: pyridoxal-dependent decarboxylase domain containing 1
  Uniprot ID: Q6P996
  ENST ID: ENST00000455313
  CDS Start-End: 121-1410
ctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcaggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctgggtgagaatggcagtcacccccctttcctttcaggtccccgtccatcaccatccgacctgctggtgagggtgacgcgtgctcgtgtatgggaactgaggcccacaggaggagccgccctgccagtgctgggcctgctctggagttctgttccccattgcgttaccacctcacgagctgggtcacctctggcaagtccttctggcattgctccctcactttccttgctgctgtataaggctgtgagacaacaggcaaaaggtgggctgcagggcagctgcggtgggttctggtgagcctgggcagcacagccgggagccccaggcagagtctgccgagcatctgcagctggcagtgtggagccaggcctgcactttgatagcgttttgggcactgaatagcagctctaggatttgagtctgaagggtcttgtgaacagtgtgggatggcggcagcagcagttctagccaatgctggacacgcccagcctagcagggttggcagataagtcctggtacatccatgctggggctcagcacagctgtgagagaccacagagctgagtgtctcaagcagaaaggaactggtcataaacgaaatgaatcaatgcaggttactaagcagtgtcaagtagcatgttttatgacaacaactacaactccctgcccgccactaggagaaaagacgctgggggcagaccacatgtcagcagtgggtgtcgcttagtaatatattgtgggtcattgttattttcttctttttgtttacttgtatttcctaaatttttctacaatgaacttgtattaataagaaaaaaccataaaatttactgtttttaaaaa

SEQ ID NO: 172626 - DNA, 2048 bp, Homo sapiens
  Payload ID: 13942
  Gene Symbol: PDXDC1
  Gene Name: pyridoxal-dependent decarboxylase domain containing 1
  ENST ID: ENST00000535621
  CDS Start-End: 189-1685
ccccgccccgccgcctctcaaccatcaggttcggcagcccgcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagacca

SEQ ID NO: 172627 - DNA, 720 bp, Homo sapiens
  Payload ID: 13942
  Gene Symbol: PDXDC1
  Gene Name: pyridoxal-dependent decarboxylase domain containing 1
  ENST ID: ENST00000565362
  CDS Start-End: 49-294
gaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccaggtaatgaacctggcagcttctcttttcaagtaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagca

SEQ ID NO: 172628 - DNA, 2963 bp, Homo sapiens
  Payload ID: 13942
  Gene Symbol: PDXDC1
  Gene Name: pyridoxal-dependent decarboxylase domain containing 1
  ENST ID: ENST00000563679
  CDS Start-End: 140-2560
agcttagatcagtgccttctctgaacagcgttcactaagcagcccccaaccccaaaacccccaagtccccgggcgccgaggacgctgcgagtcctgcgcatgcgcaaggttgcccactcgctcaccgcctccttggcgaatggcctgttccattctcgagggatgccggcgggaggtgaggcgggagacttggaagcctgggcccggaagtgagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacaga

SEQ ID NO: 172629 - DNA, 980 bp, Homo sapiens
  Payload ID: 13942
  Gene Symbol: PDXDC1
  Gene Name: pyridoxal-dependent decarboxylase domain containing 1
  ENST ID: ENST00000567306
  CDS Start-End: 167-980
ggacagccccccacgctggagaattctctggcccaaaatgtcagcagtgttgaggctgagaaatcctggtcaagatcatgtttataacaccagcagttgagtacaaaacgatgcaaagtggtgttatcaatttcctaagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcaggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctg

SEQ ID NO: 172630 - DNA, 3775 bp, Homo sapiens
  Payload ID: 13942
  Gene Symbol: PDXDC1
  Gene Name: pyridoxal-dependent decarboxylase domain containing 1
  Uniprot ID: Q6P996
  ENST ID: ENST00000569715
  CDS Start-End: 78-2363
agcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgtta

SEQ ID NO: 172631 - DNA, 884 bp, Homo sapiens
  Payload ID: 13942
  Gene Symbol: PDXDC1
  Gene Name: pyridoxal-dependent decarboxylase domain containing 1
  ENST ID: ENST00000562119
  CDS Start-End: 112-306
gccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccag

SEQ ID NO: 172632 - DNA, 554 bp, Homo sapiens
  Payload ID: 13942
  Gene Symbol: PDXDC1
  Gene Name: pyridoxal-dependent decarboxylase domain containing 1
  ENST ID: ENST00000563667
  CDS Start-End: 1-554
gttccattctcgagggatgccggcgggaggtgaggcgggagacttggaagcctgggcccggaagtgaggctgctggaaagagtttggtgaacaatccaccgggcatcctccccccttcacctgcgcacgttagggagggccggcgtggcgcccagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaa

SEQ ID NO: 172633 - DNA, 283 bp, Homo sapiens
  Payload ID: 13942
  Gene Symbol: PDXDC1
  Gene Name: pyridoxal-dependent decarboxylase domain containing 1
  ENST ID: ENST00000566426
  CDS Start-End: 211-283
aaccatcaggttcggcagcccgcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagcagaccccacgttagctgaaatgggaaaaaacttgaaggaggcagtgaagatgctggaggacagtcagagaagaacagaagaggaaaatggaa

SEQ ID NO: 172634 - DNA, 556 bp, Homo sapiens
  Payload ID: 13942
  Gene Symbol: PDXDC1
  Gene Name: pyridoxal-dependent decarboxylase domain containing 1
  ENST ID: ENST00000563522
  CDS Start-End: 196-556
aggtgcgtcactagtatttccagcctttcactccatgaatagtactttgtgattattatacttctaccttgatgattgcaacaggctgctggaaagagtttggtgaacaatccaccgggcatcctccccccttcacctgcgcacgttagggagggccggcgtggcgcccagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtg

SEQ ID NO: 172635 - DNA, 1113 bp, Homo sapiens; identical to SEQ ID NO: 172622
  Payload ID: 13942
  Gene Symbol: PDXDC1
  Gene Name: pyridoxal-dependent decarboxylase domain containing 1
  ENST ID: ENST00000610518
  CDS Start-End: 1-1113

SEQ ID NO: 172636 - DNA, 3777 bp, Homo sapiens
  Payload ID: 13942
  Gene Symbol: PDXDC1
  Gene Name: pyridoxal-dependent decarboxylase domain containing 1
  Uniprot ID: Q6P996
  ENST ID: ENST00000619589
  CDS Start-End: 78-2363
agcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcatattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacatgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgtta

SEQ ID NO: 172637 - DNA, 2183 bp, Homo sapiens
  Payload ID: 13942
  Gene Symbol: PDXDC1
  Gene Name: pyridoxal-dependent decarboxylase domain containing 1
  Uniprot ID: Q6P996
  ENST ID: ENST00000614573
  CDS Start-End: 121-1410
ctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcaggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctgggtgagaatggcagtcacccccctttcctttcaggtccccgtccatcaccatccgacctgctggtgagggtgacgcgtgctcgtgtatgggaactgaggcccacaggaggagccgccctgccagtgctgggcctgctctggagttctgttccccattgcgttaccacctcacgagctgggtcacctctggcaagtccttctggcattgctccctcactttccttgctgctgtataaggctgtgagacaacaggcaaaaggtgggctgcagggcagctgcggtgggttctggtgagcctgggcagcacagccgggagccccaggcagagtctgccgagcatctgcagctggcagtgtggagccaggcctgcactttgatagcgttttgggcactgaatagcagctctaggatttgagtctgaagggtcttgtgaacagtgtgggatggcggcagcagcggttctagccaatgctggacacgcccagcctagcagggttggcagataagtcctggtacatccatgctggggctcagcacagctgtgagagaccacagagctgagtgtctcaagcagaaaggaactggtcataaacgaaatgaatcaatgcaggttactaagcagtgtcaagtagcatgttttatgacaacaactacaactccctgcccgccactaggagaaaagacgctgggggcagaccacatgtcagcagtgggtgtcgcttagtaatatattgtgggtcattgttattttcttctttttgtttacttgtatttcctaaatttttctacaatgaacttgtattaataagaaaaaaccataaaatttactgtttttaaaaa

SEQ ID NO: 172638 - DNA, 4173 bp, Homo sapiens
  Payload ID: 13942
  Gene Symbol: PDXDC1
  Gene Name: pyridoxal-dependent decarboxylase domain containing 1
  Uniprot ID: Q6P996
  ENST ID: ENST00000614833
  CDS Start-End: 30-2123
cccagatagcagaccccacgttagctgaaatgggaaaaaacttgaaggaggcagtgaagatgctggaggacagtcagagaagaacagaagaggaaaatggaaagaagctcatatccggagatattccaggcccactccagggcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcatattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacatgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaccagtgaattcagtttataaatcttattacaaaagacttacccacgtacctgaaatagctgccgatagaccagtgagaggtaggttctcctctgcccgttattaccgaccaaaaaaaaaactggacatcaattttttagtaaaccaaaaaataagtctcaacaaatgcctttgccaaaataaggttttattttgaaagtcatttgatgaaagtcatttgaaagacactgaggagggaaggaggcctaagacccaacagatgtaggatccagatctggattcgtgccagccccaccaatggtctgtcaggccaagaaggtgctttctttggtaattcatgttttttaacttcctggagaagagatcttttcccacaagccatcttcattttttttgtagagtagggctttatttccagaaaacagtgtgtgagctggagatgggtgtttttttaaaaacatcaaggtagatctaatatgttcaacaaagtggggtggctcagccagaggcgaagtggaaagattctgaaaacacaagatggtgggcattagagaagccaaccttactgtcccctgctgtgataaagatgtcaaagtatctttgttcttggacacaaatatatataataaaatacgtt

SEQ ID NO: 172639 - DNA, 2183 bp, Homo sapiens; identical to SEQ ID NO: 172625
  Payload ID: 13942
  Gene Symbol: PDXDC1
  Gene Name: pyridoxal-dependent decarboxylase domain containing 1
  Uniprot ID: Q6P996
  ENST ID: ENST00000613798
  CDS Start-End: 121-1410

SEQ ID NO: 172640 - DNA, 2047 bp, Homo sapiens
  Payload ID: 13942
  Gene Symbol: PDXDC1
  Gene Name: pyridoxal-dependent decarboxylase domain containing 1
  ENST ID: ENST00000610865
  CDS Start-End: 189-1685
ccccgccccgccgcctctcaaccatcaggttcggcagcccgcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataattaataaataaaacatcaaagacc

SEQ ID NO: 172641 - DNA, 1819 bp, Homo sapiens
  Payload ID: 13942
  Gene Symbol: PDXDC1
  Gene Name: pyridoxal-dependent decarboxylase domain containing 1
  ENST ID: ENST00000621760
  CDS Start-End: 865-1479
gaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccaggtaatgaacctggcagcttctcttttcaagtaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagggtggtcccactgtgggaccacaaccaggtatgactgtgtgagaagcaggctcactaccaggctaccagggagcacaggggagcaggcgccaccttgaggcataaacccagagaaacaagacctccaagacggccaggcactggggcacacgccggtaacacagcaccgtgggagctgagacggaaggatcgcctgagcccaggattttgaaaccaccctgggcaacacagtgagaccccgtatctacaaaaaaatacacattagccaggcatggcggcatgcgcctggggtcccaagtactcgggaggtagaggagagaaaaatcacttgagcccagagaggtcaaggctacagggagctgagatcgcatcactgtactccagctggggtgaaacggcgagactctacctcaaaaataaataaatacatacataatt

SEQ ID NO: 172642 - DNA, 1113 bp, Homo sapiens; identical to SEQ ID NO: 172622
  Payload ID: 13942
  Gene Symbol: PDXDC1
  Gene Name: pyridoxal-dependent decarboxylase domain containing 1
  ENST ID: ENST00000611292
  CDS Start-End: 1-1113

SEQ ID NO: 172643 - DNA, 2048 bp, Homo sapiens; identical to SEQ ID NO: 172626
  Payload ID: 13942
  Gene Symbol: PDXDC1
  Gene Name: pyridoxal-dependent decarboxylase domain containing 1
  ENST ID: ENST00000614060
  CDS Start-End: 189-1685

SEQ ID NO: 172644 - DNA, 1819 bp, Homo sapiens; identical to SEQ ID NO: 172641
  Payload ID: 13942
  Gene Symbol: PDXDC1
  Gene Name: pyridoxal-dependent decarboxylase domain containing 1
  ENST ID: ENST00000615160
  CDS Start-End: 865-1479

SEQ ID NO: 172645 - DNA, 4523 bp, Homo sapiens
  Payload ID: 13942
  Gene Symbol: PDXDC1
  Gene Name: pyridoxal-dependent decarboxylase domain containing 1
  Uniprot ID: Q6P996
  ENST ID: ENST00000618389
  CDS Start-End: 98-2464
cgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcatattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacatgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacagaggcgagactggctgtatcctttgctgtcggtctttagtacgatcaagttgcaatatacagtgggactgctagacttgaaggagagcagtgattgtgggattgtaaataagagcatcagaagccctccccagctactgctcttcgtggagacttagtaaggactgtgtctacttgagctgtggcaaggctgctgtctgggactgtcctctgccacaaggccatttctcccattatataccgtttgtaaagagaaactgtaaagtctcctcctgaccatatatttttaaatactggcaaagcttttaaaattggcacacaagtacagactgtgctcatttctgtttagtatctgaaaacctgatagatgctacccttaagagcttgctcttccgtgtgctacgtagcacccacctggttaaaatctgaaaacaagtacccctttgacctgtctcccactgaagcttctactgccctggcagctcgcctgggcccaactcagaaacaggagccagcagagcactctctcacgctgatccagccgggcaccctgcttaagtcagtagaagctcgctggcactgcccgttcctacttttccgaagtactgcgtcactttgtcgtaagtaatggcccctgtgccttcttaatccagcagtcaagcttttgggagacctgaaaatgggaaaattcacactgggtttctggactgtagtattggaagccttagttatagtatattaagcctataattatactctgatttgatgggatttttgacatttacacttgtcaaaatgcagggggttttttttggtgcagatgattaaacagtcttccctatttggtgcaatgaagtatagcagataaaatgggggaggggtaaattatcaccttcaagaaaattacatgtttttatatatatttggaattgttaaattggttttgctgaaacatttcacccttgagatattatttgaatgttggtttcaataaaggttcttgaaattgttaccagtgaattcagtttataaatcttattacaaaagacttacccacgtacctgaaatagctgccgatagaccagtgagaggtaggttctcctctgcccgttattaccgaccaaaaaaaaaactggacatcaattttttagtaaaccaaaaaataagtctcaacaaatgcctttgccaaaataaggttttattttgaaagtcatttgatgaaagtcatttgaaagacactgaggagggaaggaggcctaagacccaacagatgtaggatccagatctggattcgtgccagccccaccaatggtctgtcaggccaagaaggtgctttctttggtaattcatgttttttaacttcctggagaagagatcttttcccacaagccatcttcattttttttgtagagtagggctttatttccagaaaacagtgtgtgagctggagatgggtgtttttttaaaaacatcaaggtagatctaatatgttcaacaaagtggggtggctcagccagaggcgaagtggaaagattctgaaaacacaagatggtgggcattagagaagccaaccttactgtcccctgctgtgataaagatgtcaaagtatctttgttcttggacacaaatatatataataaaatacgttaagaaatga

SEQ ID NO: 172646 - DNA, 2965 bp, Homo sapiens
  Payload ID: 13942
  Gene Symbol: PDXDC1
  Gene Name: pyridoxal-dependent decarboxylase domain containing 1
  ENST ID: ENST00000617553
  CDS Start-End: 140-2560
agcttagatcagtgccttctctgaacagcgttcactaagcagcccccaaccccaaaacccccaagtccccgggcgccgaggacgctgcgagtcctgcgcatgcgcaaggttgcccactcgctcaccgcctccttggcgaatggcctgttccattctcgagggatgccggcgggaggtgaggcgggagacttggaagcctgggcccggaagtgagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggtgagcatcctccagttagttcagaatctcatgcatggagatgaagatgaggagccccagagccccagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcatattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacatgtttgctgtcctactacgacttttccctaagttaccataaacacattttattcacaaaaaacacttcgaatttcaagtgtctaccagtagcacccttgctctttctaaacataagcctaagtatatgaggttgcccgtggcaactttttggtaaaacagcttttcattagcactctccaggttctctgcaacacttcacaga

SEQ ID NO: 172647 - DNA, 2683 bp, Homo sapiens
  Payload ID: 13942
  Gene Symbol: PDXDC1
  Gene Name: pyridoxal-dependent decarboxylase domain containing 1
  Uniprot ID: Q6P996
  ENST ID: ENST00000627450
  CDS Start-End: 72-2354
gaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaacagaagaggaaaatggaaagaagctcatatccggagatattccaggcccactccagggcagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcacattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacgtttgctgtcctactacgacttttccctaagttaccataaacacattttattcacaaaaaacacttcgaatttcaagtgtctaccagtagcacccttgctctttctaaacataagcctaagtatatga

SEQ ID NO: 172648 - DNA, 884 bp, Homo sapiens
  Payload ID: 13942
  Gene Symbol: PDXDC1
  Gene Name: pyridoxal-dependent decarboxylase domain containing 1
  ENST ID: ENST00000633039
  CDS Start-End: 112-306
gccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagtgggcaagatatggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcatattgaagacttagaaaaggtggagcgcctatccagtgggccggagcagatcaccctcgaggccagcagcactgagggacacccaggggctcccagccctcagcacaccgaccag

SEQ ID NO: 172649 - DNA, 554 bp, Homo sapiens; identical to SEQ ID NO: 172632
  Payload ID: 13942
  Gene Symbol: PDXDC1
  Gene Name: pyridoxal-dependent decarboxylase domain containing 1
  ENST ID: ENST00000633216
  CDS Start-End: 1-554

SEQ ID NO: 172650 - DNA, 474 bp, Homo sapiens
  Payload ID: 13942
  Gene Symbol: PDXDC1
  Gene Name: pyridoxal-dependent decarboxylase domain containing 1
  ENST ID: ENST00000632387
  CDS Start-End: 180-474
gccgcctctcaaccatcaggttcggcagcccgcggcgccgcctggcagctcctcctcttctccgccccgccggccgcgggcgcgggggacgtcagcgctgccagcgtggaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaagaacagaagaggaaaatggaaagaagctcatatccggagatattccaggcccactccagggcagaatccaaaatattggagaacaaggtcatatggctttgttgggacatagtctgggagcttatatttcaactctggacaaagagaagctgagaaaacttacaactaggatactttcagataccaccttatggctat

SEQ ID NO: 172651 - DNA, 2685 bp, Homo sapiens
  Payload ID: 13942
  Gene Symbol: PDXDC1
  Gene Name: pyridoxal-dependent decarboxylase domain containing 1
  Uniprot ID: Q6P996
  ENST ID: ENST00000631842
  CDS Start-End: 72-2354
gaaggagctgcggggcgcgggaggaggaagtagagcccgggaccgccaggccaccaccggccgcctcagccatggacgcgtccctggagaagatagcagaccccacgttagctgaaatgggaaaaaacttgaaggaggcagtgaagatgctggaggacagtcagagaacagaagaggaaaatggaaagaagctcatatccggagatattccaggcccactccagggcagaatccaaaatattggagaacaaggtcatatggctttgttgggacatagtctgggagcttatatttcaactctggacaaagagaagctgagaaaacttacaactaggatactttcagataccaccttatggctatgcagaattttcagatatgaaaatgggtgtgcttatttccacgaagaggaaagagaaggacttgcaaagatatgtaggcttgccattcattctcgatatgaagacttcgtagtggatggcttcaatgtgttatataacaagaagcctgtcatatatcttagtgctgctgctagacctggcctgggccaatacctttgtaatcagctcggcttgcccttcccctgcttgtgccgtgtaccctgtaacactgtgtttggatcccagcatcagatggatgttgccttcctggagaaactgattaaagatgatatagagcgaggaagactgcccctgttgcttgtcgcaaatgcaggaacggcagcagtaggacacacagacaagattgggagattgaaagaactctgtgagcagtatggcatatggcttcatgtggagggtgtgaatctggcaacattggctctgggttatgtctcctcatcagtgctggctgcagccaaatgtgatagcatgacgatgactcctggcccgtggctgggtttgccagctgttcctgcggtgacactgtataaacacgatgaccctgccttgactttagttgctggtcttacatcaaataagcccacagacaaactccgtgccctgcctctgtggttatctttacaatacttgggacttgatgggtttgtggagaggatcaagcatgcctgtcaactgagtcaacggttgcaggaaagtttgaagaaagtgaattacatcaaaatcttggtggaagatgagctcagctccccagtggtggtgttcagatttttccaggaattaccaggctcagatccggtgtttaaagccgtcccagtgcccaacatgacaccttcaggagtcggccgggagaggcactcgtgtgacgcgctgaatcgctggctgggagaacagctgaagcagctggtgcctgcaagcggcctcacagtcatggatctggaagctgagggcacgtgtttgcggttcagccctttgatgaccgcagcagttttaggaactcggggagaggatgtggatcagctcgtagcctgcatagaaagcaaactgccagtgctgtgctgtacgctccagttgcgtgaagagttcaagcaggaagtggaagcaacagcaggtctcctatatgttgatgaccctaactggtctggaataggggttgtcaggtatgaacatgctaatgatgataagagcagtttgaaatcagatcccgaaggggaaaacatccatgctggactcctgaagaagttaaatgaactggaatctgacctaacctttaaaataggccctgagtataagagcatgaagagctgcctttatgtcggcatggcgagcgacaacgtcgatgctgctgagctcgtggagaccattgcggccacagcccgggagatagaggagaactcgaggcttctggaaaacatgacagaagtggttcggaaaggcattcaggaagctcaagtggagctgcagaaggcaagtgaagaacggcttctggaagagggggtgttgcggcagatccctgtagtgggctccgtgctgaattggttttctccggtccaggctttacagaagggaagaacttttaacttgacagcaggctctctggagtccacagaacccatatatgtctacaaagcacaaggtgcaggagtcacgctgcctccaacgccctcgggcagtcgcaccaagcagaggcttccaggccagaagccttttaaaaggtccctgcgaggttcagatgctttgagtgagaccagctcagtcagtcatattgaagacttagaaaaggtggagcgcctatccagtgggccggagcagatcaccctcgaggccagcagcactgagggacacccaggggctcccagccctcagcacaccgaccagaccgaggccttccagaaaggggtcccacacccagaagatgaccactcacaggtagaaggaccggagagcttaagatgagactcattgtgtggtttgagactgtactgagtattgtttcagggaagatgaagttctattggaaatgtgaactgtgccacatactaatataaattactgttgtttgtgcttcactgggattttggcacaaatatgtgcctgaaaggtaggctttctaggaggggagtcagcttgtctaacttcatgtacatgtagaaccacatgtttgctgtcctactacgacttttccctaagttaccataaacacattttattcacaaaaaacacttcgaatttcaagtgtctaccagtagcacccttgctctttctaaacataagcctaagtatatga

SEQ ID NO: 172652 - DNA, 2397 bp, Homo sapiens
  Payload ID: 13943
  Gene Symbol: PNPO
  Gene Name: pyridoxamine 5'-phosphate oxidase
  Uniprot ID: Q9NVS9
  ENST ID: ENST00000225573
  CDS Start-End: 106-891
aaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggcatttgaggagactcatctgacctcccttgacccagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaactggagagatccagaaccttgggagtcattaaagccaagtcattcatagcagccaggaaacaataggaaccaaaagcctctgcctgctgctattgcaattcccaggatctctccttccctggatccctccctcccaggtctgggctgtgcagttcctccccctgccttaaaacaccccactatctctgtaaagtctctctctctcttttttttttttttacttaatctagctagaatctatttctgttgattacaacttaactaactcatttacggataggacttttttttttctttttttcttttttcttttcttttttttttttgagatggagtctcactctgtcacccaggctggagtgcagtggtgtgatcttggctcactgcaacctctgcctcccaggttcaagcaattctcctgcctcagcctcccaagtagctgggactacaggcacacgccaccacacccaactaatttttgtatttttagtagagatggggtttcaccatgttggccaggattgtctccatctcttgaccttgtgatccacccacctcagcctcccaaagtgctgggattacaggcatgagccaccacacccagcgagacggggtttcattatgttggccaggctggtctccaactcctgacctaaagtgatctgcccgccttggcctcccaaagtgctgggattacagacatgagccaccacgcttggccgggatagtatatttttatagcacttcccctactgattgctgccttctctgtggctacaagggacccacagaattacagggaagttacagggaagcaggtttcatctcaatattgggagagatttcaaacaatcacacctgcctgagaaggagtgggctgtcactaggaatttttattcccagtccgtcaggaattttgtagaagggcttcatgtgctggtaccaataggacaggaagattttaatcagctttactatctatgtttttttatggaaactgtgtgtatgtatacatacattttccaaaaagaaaaattaaatgattatagagattatgtttttcagact

SEQ ID NO: 172653 - DNA, 1210 bp, Homo sapiens
  Payload ID: 13943
  Gene Symbol: PNPO
  Gene Name: pyridoxamine 5'-phosphate oxidase
  Uniprot ID: Q9NVS9
  ENST ID: ENST00000434554
  CDS Start-End: 106-762
aaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggcatttgaggagactcatctgacctcccttgacccagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaactggagagat

SEQ ID NO: 172654 - DNA, 503 bp, Homo sapiens
  Payload ID: 13943
  Gene Symbol: PNPO
  Gene Name: pyridoxamine 5'-phosphate oxidase
  ENST ID: ENST00000585320
  CDS Start-End: 59-268
cgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagagagatggaaaaccctctgctcgcatgttgctgctgaagggcttcgggaaagatggcttccgcttcttcactaacttcgagagtcgaaaaggaaaagagctgtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggag

SEQ ID NO: 172655 - DNA, 887 bp, Homo sapiens
  Payload ID: 13943
  Gene Symbol: PNPO
  Gene Name: pyridoxamine 5'-phosphate oxidase
  ENST ID: ENST00000583245
  CDS Start-End: 106-324
aaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagaggtgccgccgctagggccaggcctcctgcaggggcgggggaaaaggggtccccggagtcatctacagcggggaggggagtagtaggagcccctcggggcttctggggccacccggtggggcaaggaggtttgaggatcaccccccgtgggaaaagggggcttcaaagacatcccaccaggggaggagttccggggaaacgcaaatgaagatgggttcaaaaggcagcctttcgtaatgggcatttgaggagactcatctgacctcccttgacccagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgctacttccactcccgccccaagagcagccagattggggctgtggtcagccaccagagttctgtgatccctgatcggg

SEQ ID NO: 172656 - DNA, 560 bp, Homo sapiens
  Payload ID: 13943
  Gene Symbol: PNPO
  Gene Name: pyridoxamine 5'-phosphate oxidase
  ENST ID: ENST00000583599
  CDS Start-End: 200-560
ctccgatcctggaaactcattggctccgaggacttaggacctgttagcttggttgggcgactggcaaatccttccttccccggggtagaagtccagggcatttgaggagactcatctgacctcccttgacccagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgc

SEQ ID NO: 172657 - DNA, 537 bp, Homo sapiens
  Payload ID: 13943
  Gene Symbol: PNPO
  Gene Name: pyridoxamine 5'-phosphate oxidase
  ENST ID: ENST00000584061
  CDS Start-End: 106-246
aaatccttccttccccggggtagaagtccagggtgagaaattggttccgaactcaaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagagtgaaacagtttgctgcctggtttgaggaggctgttcagtgtcctgacataggggaagccaatgccatgtgtctggctacctgcaccagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgct

SEQ ID NO: 172658 - DNA, 1152 bp, Homo sapiens
  Payload ID: 13943
  Gene Symbol: PNPO
  Gene Name: pyridoxamine 5'-phosphate oxidase
  ENST ID: ENST00000582171
  CDS Start-End: 52-261
aaaggaacccagtgccgggccacagccgggtcacgtggccggcggccccccatgacgtgctggctgcggggcgtcacggcgacgttcgggcgacctgccgagtggccaggctacctcagtcacctgtgtggtcgcagtgctgccatggacctgggacccatgcgcaagagttaccgcggggaccgagagagatggaaaaccctctgctcgcatgttgctgctgaagggcttcgggaaagatggcttccgcttcttcactaacttcgagagtcgaaaaggaaaagagctggactctaatccctttgcttcccttgtcttctactgggagccacttaaccgtcaggtgcgtgtggaaggccctgtgaagaaactgcctgaggaggaggctgagtgctacttccactcccgccccaagagcagccagattggggctgtggtcagccaccagagttctgtgatccctgatcgggagtatctgagaaagaaaaatgaggaactggaacagctctaccaggatcaagaggtgcccaagccaaaatcctggggtggctatgtcctgtaccctcaggtgatggagttctggcaaggtcaaaccaaccgcctgcatgaccggatagtctttcggcggggcctacccacaggagattcccctttggggcccatgacccaccgcggggaggaagactggctctatgagagacttgcaccttaactctgggacctgctggcccagagtggagctagggctaggtgtcaagagagggtgtgggattgggacccaggcccttctttctaaactcaacccatttccctccctaccccttatcttcaggactcttcagagctaatcctctaagttctctgtactcagttggttctcagttagctggtcaagtggagtgtaatggtggcgtagagaatcacaaatggaaaataattccataattatttttttgaccttgcctatgattgattaggatagctccctctaggggtagcagccggtgtgactccctttctggtgacagacagggccccagcagccctgtctgttaccatgtgagtcatactggccaaagcttagtcctagcatatgcacctgagccaacctggccaatcagattgttttgtcaataatttgaaatttgaact

SEQ ID NO: 172659 - DNA, 1595 bp, Homo sapiens
  Payload ID: 13944
  Gene Symbol: P2RY4
  Gene Name: pyrimidinergic receptor P2Y, G-protein coupled, 4
  Uniprot ID: P51582
  ENST ID: ENST00000374519
  CDS Start-End: 141-1238
cagatgcgcttctgtcagctctccctagtgcttcaaccactgctctccctgctctactttttttgctccagctcagggatgggggtgggcagggaaatcctgccaccctcacttctccccttcccatctccaggggggccatggccagtacagagtcctccctgttgagatccctaggcctcagcccaggtcctggcagcagtgaggtggagctggactgttggtttgatgaggatttcaagttcatcctgctgcctgtgagctatgcagttgtctttgtgctgggcttgggccttaacgccccaaccctatggctcttcatcttccgcctccgaccctgggatgcaacggccacctacatgttccacctggcattgtcagacaccttgtatgtgctgtcgctgcccaccctcatctactattatgcagcccacaaccactggccctttggcactgagatctgcaagttcgtccgctttcttttctattggaacctctactgcagtgtccttttcctcacctgcatcagcgtgcaccgctacctgggcatctgccacccacttcgggcactacgctggggccgccctcgcctcgcaggccttctctgcctggcagtttggttggtcgtagccggctgcctcgtgcccaacctgttctttgtcacaaccagcaacaaagggaccaccgtcctgtgccatgacaccactcggcctgaagagtttgaccactatgtgcacttcagctcggcggtcatggggctgctctttggcgtgccctgcctggtcactcttgtttgctatggactcatggctcgtcgcctgtatcagcccttgccaggctctgcacagtcgtcttctcgcctccgctctctccgcaccatagctgtggtgctgactgtctttgctgtctgcttcgtgcctttccacatcacccgcaccatttactacctggccaggctgttggaagctgactgccgagtactgaacattgtcaacgtggtctataaagtgactcggcccctggccagtgccaacagctgcctggatcctgtgctctacttgctcactggggacaaatatcgacgtcagctccgtcagctctgtggtggtggcaagccccagccccgcacggctgcctcttccctggcactagtgtccctgcctgaggatagcagctgcaggtgggcggccaccccccaggacagtagctgctctactcctagggcagatagattgtaacacgggaagccgggaagtgagagaaaaggggatgagtgcagggcagaggtgagggaacccaatagtgatacctggtaaggtgcttcttcctcttttccaggctctggagagaagccctcaccctgagggttgcagggaggcagggatatcatgggtgacctcatctctcataaccccttcagttgccgactctttttagccaatgccaatcttctactcctttctcgttgtttctgttccttcctggggccattggtcctacaatcttcctgaaaatcttccccagtcctctttccctgtcccatttcccccacagcctcctatagcatgtgtttctctacccagaccagagcattc

SEQ ID NO: 172660 - DNA, 1700 bp, Homo sapiens
  Payload ID: 13945
  Gene Symbol: P2RY6
  Gene Name: pyrimidinergic receptor P2Y, G-protein coupled, 6
  Uniprot ID: Q15077
  ENST ID: ENST00000349767
  CDS Start-End: 414-1400
tctgggttccagggacgctggggccggagctgctgccgccgtctacacggtcccctcatttgacgggttcgcctcctagcagcgcctgggcgagtgacatctgggccggaccagctggtgctgcgcggcgcaggtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtca

SEQ ID NO: 172661 - DNA, 2398 bp, Homo sapiens
  Payload ID: 13945
  Gene Symbol: P2RY6
  Gene Name: pyrimidinergic receptor P2Y, G-protein coupled, 6
  Uniprot ID: Q15077
  ENST ID: ENST00000393590
  CDS Start-End: 300-1286
gtcagcattggtgtaaaggactggagcttcagggttctcgggattcgagtcctggccctgctgcttgccagctctgtgctgtggcaagttacttcctctccccaggtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtcatcaaggggtatgctccatgctttgagtcaccaatgaagcgggtgagggaagatgagagggggaggtgagagcttctgggaaggggcatttgagctgggttttgagggatgattatgagctctctggagaggagtgatattccatttatttagaaagcctttactgacaccttgtgctcaggcctgtgttggttctggggccctagaagaaccagtcctagccctggtccatacgggctcccaactgctggaagtacagactggcacagcaacatcagggttgtgacagagggaagcatggctggggggagggggtacacagacagtgcccatgacccagtccaaggagtcaggaaagagctctctgaggagggagcatctgagccagatgttgagggctgagtgggaacttggcaagcagaagtggggagcactttaatgcaacccaggtatgctccatgcatatccagctgggccagcctcgtgctgggctctgccctgggcagacaggcagagggccagagcagaggacacatggccttgcgtgtgtgaaagctgagaaaatgggagctgtgcttcagctaccctccagacaagggcaagagttagccagatgctccaggcagtgggaagccaatggagggattaagcggcggaagcttcttagaagaggcagggggcgaagtgcagtggctcatgcctgtaatctcagcaatttgggaggccaaggaaggaggaatgcttgagcccaagagttttagaccagcctgggcaacacagtaagaccctgtttctacaaaaaaatataaaaaa

SEQ ID NO: 172662 - DNA, 1829 bp, Homo sapiens
  Payload ID: 13945
  Gene Symbol: P2RY6
  Gene Name: pyrimidinergic receptor P2Y, G-protein coupled, 6
  Uniprot ID: Q15077
  ENST ID: ENST00000393591
  CDS Start-End: 543-1529
aaggacagaggaggggcccttcctgtcagctggctgggagcagaggtggctttgtcttttcggaagaactggttctgtggaatttgtgcttatttcccatcaaggatcaaggacctgctctggggctacctcagggccccacaggatgaggggctggttttcagatgagttttctgcttgcctgtcatctggatagtgtctaaaaatttgcaaactgccttcttgtcagtgtcttgctcattcttcatgacactcctgatatgtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtca

SEQ ID NO: 172663 - DNA, 1515 bp, Homo sapiens
  Payload ID: 13945
  Gene Symbol: P2RY6
  Gene Name: pyrimidinergic receptor P2Y, G-protein coupled, 6
  Uniprot ID: Q15077
  ENST ID: ENST00000393592
  CDS Start-End: 232-1218
gccggagctgctgccgccgtctacacggtcccctcatttgacgggttcgcctcctagcagcgcctgggcgagtgacatctgggccggaccagctggtgctgcgcggcgcagataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactg

SEQ ID NO: 172664 - DNA, 800 bp, Homo sapiens
  Payload ID: 13945
  Gene Symbol: P2RY6
  Gene Name: pyrimidinergic receptor P2Y, G-protein coupled, 6
  ENST ID: ENST00000535931
  CDS Start-End: 65-800
ccagtggctcctgtgaccacatcgaccaggcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctg

SEQ ID NO: 172665 - DNA, 741 bp, Homo sapiens
  Payload ID: 13945
  Gene Symbol: P2RY6
  Gene Name: pyrimidinergic receptor P2Y, G-protein coupled, 6
  ENST ID: ENST00000544437
  CDS Start-End: 357-741
cgggagggcttgggagagtgaaagctcacccggatctgggtggagaaagtatgacaggtcccaggctcaccctctcacacatacaaacacatgcacatacaagagaagctgctccgaaatctcatttttttatcttccaaaattcctgtggattttgcattcttctataatatttctgcatataaaaacactgttctgataaattaccatccaatgagttggctcaagtcttggagataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatct

SEQ ID NO: 172666 - DNA, 335 bp, Homo sapiens
  Payload ID: 13945
  Gene Symbol: P2RY6
  Gene Name: pyrimidinergic receptor P2Y, G-protein coupled, 6
  ENST ID: ENST00000536225
  CDS Start-End: 168-335
gctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgc

SEQ ID NO: 172667 - DNA, 2351 bp, Homo sapiens
  Payload ID: 13945
  Gene Symbol: P2RY6
  Gene Name: pyrimidinergic receptor P2Y, G-protein coupled, 6
  Uniprot ID: Q15077
  ENST ID: ENST00000540124
  CDS Start-End: 1066-2052
accggtggtcagagtgaaacagaacagaacgggaggtttcacaatgtccttccatacaatctctggaatctatagataacaacagctgctaggtcaggggtcgaattttaactaccaggcttaggtcaggcaggcccaggcctggtttcgggtctggttccttggtttcgggtctggttccttggtttcaggtctggtttttaggcgccgggctacctgcctttagtttcgcttctctttccttttccgagtataaaacagtatgagagggtctctctcctccctcagtgccatcctcatccctgggtgggagttgtctggatccatagggttggagccacagataacagagccattaatctcggggtctcagcctctcttaacggaccttccaggcactgctgagaaaaccaggttaatggtttcctgcggcagcaatgagcagaagcagggccatctccagactccagagaagccaggagagggctggggtgataatggggaggaggataaaaaacagccacccaatgcgtgccttccctgtgccaggcccttgtcctgaaatgttatctcactccatcctcccaacagtcccttgggctaaattggtgatgctgcttgtttgagtgagcaaacagagggtgaatgaagtgacttgcgggcagctgggtagaggatgagtcagcattggtgtaaaggactggagcttcagggttctcgggattcgagtcctggccctgctgcttgccagctctgtgctgtggcaagttacttcctctccccaggtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtc

SEQ ID NO: 172668 - DNA, 1425 bp, Homo sapiens
  Payload ID: 13945
  Gene Symbol: P2RY6
  Gene Name: pyrimidinergic receptor P2Y, G-protein coupled, 6
  Uniprot ID: Q15077
  ENST ID: ENST00000538328
  CDS Start-End: 174-1160
gaaacagaggaagctgctcactctgtcagagaagttgcagcctagctgagggcaggagagtggggagcctcaggtctggcttccctttgccccaacacacttgggaccaccagcgtgctgcagggacaggaggctgcctcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaag

SEQ ID NO: 172669 - DNA, 1611 bp, Homo sapiens
  Payload ID: 13945
  Gene Symbol: P2RY6
  Gene Name: pyrimidinergic receptor P2Y, G-protein coupled, 6
  Uniprot ID: Q15077
  ENST ID: ENST00000540342
  CDS Start-End: 340-1326
tgctctggctcctctgggttccagggacgctggggccggagctgctgccgccgtctacacggtcccctcatttgacgggttcgcctcctagcagcgcctgggcgagtgacatctgggccggaccagctggtgctgcgcggcgcaggtctctcggtttcctcatctgctgcctctccagacttctgccagaacattgcacgcgacagtttcaggcacagaactgactggcagcaggggctgctccacgagtgggaatttgctccagcacttcacggactgcaagcgaggcacttgctaactcttggcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtg

SEQ ID NO: 172670 - DNA, 1674 bp, Homo sapiens
  Payload ID: 13945
  Gene Symbol: P2RY6
  Gene Name: pyrimidinergic receptor P2Y, G-protein coupled, 6
  Uniprot ID: Q15077
  ENST ID: ENST00000542092
  CDS Start-End: 388-1374
tggctcctctgggttccagggacgctggggccggagctgctgccgccgtctacacggtcccctcatttgacgggttcgcctcctagcagcgcctgggcgagtgacatctgggccggaccagctggtgctgcgcggcgcagacttctgccagaacattgcacgcgacagtttcaggcacagaactgactggcagcaggggctgctccacgagtgggaatttgctccagcacttcacggactgcaagcgaggcacttgctaactcttggataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtca

SEQ ID NO: 172671 - DNA, 2431 bp, Homo sapiens
  Payload ID: 13945
  Gene Symbol: P2RY6
  Gene Name: pyrimidinergic receptor P2Y, G-protein coupled, 6
  Uniprot ID: Q15077
  ENST ID: ENST00000618468
  CDS Start-End: 351-1337
ggcttgggagagtgaaagctcacccggatctgggtggagaaagtatgacaggtcccaggctcaccctctcacacatacaaacacatgcacatacaagagaagctgctccgaaatctcatttttttatcttccaaaattcctgtggattttgcattcttctataatatttctgcatataaaaacactgttctgataaattaccatccaatgagttggctcaagtcttggagataacaagacctctgccagaagaaccatggctttggaaggcggagttcaggctgaggagatgggtgcggtcctcagtgagcccctgcctccctgaacataggaaacccacctgggcagccatggaatgggacaatggcacaggccaggctctgggcttgccacccaccacctgtgtctaccgcgagaacttcaagcaactgctgctgccacctgtgtattcggcggtgctggcggctggcctgccgctgaacatctgtgtcattacccagatctgcacgtcccgccgggccctgacccgcacggccgtgtacaccctaaaccttgctctggctgacctgctatatgcctgctccctgcccctgctcatctacaactatgcccaaggtgatcactggccctttggcgacttcgcctgccgcctggtccgcttcctcttctatgccaacctgcacggcagcatcctcttcctcacctgcatcagcttccagcgctacctgggcatctgccacccgctggccccctggcacaaacgtgggggccgccgggctgcctggctagtgtgtgtagccgtgtggctggccgtgacaacccagtgcctgcccacagccatcttcgctgccacaggcatccagcgtaaccgcactgtctgctatgacctcagcccgcctgccctggccacccactatatgccctatggcatggctctcactgtcatcggcttcctgctgccctttgctgccctgctggcctgctactgtctcctggcctgccgcctgtgccgccaggatggcccggcagagcctgtggcccaggagcggcgtggcaaggcggcccgcatggccgtggtggtggctgctgcctttgccatcagcttcctgccttttcacatcaccaagacagcctacctggcagtgcgctcgacgccgggcgtcccctgcactgtattggaggcctttgcagcggcctacaaaggcacgcggccgtttgccagtgccaacagcgtgctggaccccatcctcttctacttcacccagaagaagttccgccggcgaccacatgagctcctacagaaactcacagccaaatggcagaggcagggtcgctgagtcctccaggtcctgggcagccttcatatttgccattgtgtccggggcaccaggagccccaccaaccccaaaccatgcggagaattagagttcagctcagctgggcatggagttaagatccctcacaggacccagaagctcaccaaaaactatttcttcagccccttctctggcccagaccctgtgggcatggagatggacagacctgggcctggctcttgagaggtcccagtcagccatggagagctggggaaaccacattaaggtgctcacaaaaatacagtgtgacgtgtactgtcatcaaggggtatgctccatgctttgagtcaccaatgaagcgggtgagggaagatgagagggggaggtgagagcttctgggaaggggcatttgagctgggttttgagggatgattatgagctctctggagaggagtgatattccatttatttagaaagcctttactgacaccttgtgctcaggcctgtgttggttctggggccctagaagaaccagtcctagccctggtccatacgggctcccaactgctggaagtacagactggcacagcaacatcagggttgtgacagagggaagcatggctggggggagggggtacacagacagtgcccatgacccagtccaaggagtcaggaaagagctctctgaggagggagcatctgagccagatgttgagggctgagtgggaacttggcaagcagaagtggggagcactttaatgcaacccaggtatgctccatgcatatccagctgggccagcctcgtgctgggctctgccctgggcagacaggcagagggccagagcagaggacacatggccttgcgtgtgtgaaagctgagaaaatgggagctgtgcttcagctaccctccagacaagggcaagagttagccagatgctccaggcagtgggaagccaatggagggattaagcggcggaagcttcttagaagaggcagggggcgaagtgcagtggctcatgcctgtaatctcagcaatttgggaggccaaggaaggaggaatgcttgagcccaagagttttagaccagcctgggcaacacagtaagaccctgtttct

SEQ ID NO: 172672 - DNA, 1662 bp, Homo sapiens
  Payload ID: 13946
  Gene Symbol: PYHIN1
  Gene Name: pyrin and HIN domain family, member 1
  Uniprot ID: Q6K0P9
  ENST ID: ENST00000368135
  CDS Start-End: 230-967
agcactagtcaagtgactctaagaagggccattttcccttgttgtctttgaaaatacttcattttcttagcatttcaggagattataacatcctgtatttcagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagttgcaaataaaattgaatccattccagtcaaaggaataatcccatctaaaaagacgaaacagaaagaagtgtatcctgctacacctgcatgcaccccaagcaaccgtctcacagctaaaggagcagaggagactcttggacctcagaaaagaaaaaaaccatctgaagaagagactggaaccaaaaggagtaagatgtccaaagagcagactcggccttcctgctctgcaggagccagcacgtccacagccatgggccgttccccacctccccagacctcatcatcagctccacccaacacttcctcaactgaggcatatttgatgaacttgacattatctctgactgcaggaagttttctgtcctgtgctgtttggggaagagacagagaactgcggaatctggaactttcagcaacagactcactgtctactgcccccatctattatacacccattccctttgctcactaatttgttcaagtttctctgacatacaccatgctcctttttcctttaggattttcacacaccatatttctttcacctttaaactcttacctggccaaccctatccaccctctggatcccaatattgagatcttatcctcagggaatcctcacttagacccctgtaacaggttaaatcttcatggtgttctgtttcctaggaacttctttcttttctactgtttatgacaactgaagttaataagtgtttatctttcccacctactcaaagtagttccaagattagggctagtttgtaattctgtggaccactgtaaacgagggcctagttcagtgtctgcctcatgggaagcttccaataaatacctttgctcaacgaaaaaatgaaaacccagtggctcacgcctgtaatcccagcactttgggaggccgaggcaggtggattgcctgaggtcaggagtttgagactagtctggccaacatggtgaaacactatctctactaaaaatacaaaaaaattagctgggtatggtggcttacgcctataatcccagctactcaggaggctgaggcaggggaattgcttgaaccagggaggtggaggttgcagtgagctgagatcgcaccactgcactccagcctgggtgacagagcgagactccatctcaaaataaaaaagtaaaaaaaaaaaaaaaaaa

SEQ ID NO: 172673 - DNA, 1723 bp, Homo sapiens
  Payload ID: 13946
  Gene Symbol: PYHIN1
  Gene Name: pyrin and HIN domain family, member 1
  Uniprot ID: Q6K0P9
  ENST ID: ENST00000368138
  CDS Start-End: 239-1690
gaggaagccagcactagtcaagtgactctaagaagggccattttcccttgttgtctttgaaaatacttcattttcttagcatttcaggagattataacatcctgtatttcagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagtcaaaggaataatcccatctaaaaagacgaaacagaaagaagtgtatcctgctacacctgcatgcaccccaagcaaccgtctcacagctaaaggagcagaggagactcttggacctcagaaaagaaaaaaaccatctgaagaagagactggaaccaaaaggagtaagatgtccaaagagcagactcggccttcctgctctgcaggagccagcacgtccacagccatgggccgttccccacctccccagacctcatcatcagctccacccaacacttcctcaactgagagcctaaaaccattggccaaccgtcacgcaactgccagtaaaaatattttccgagaagacccaataatcgcgatggtactaaatgcaacaaaagtatttaaatatgaatcctcagaaaatgagcaaagaagaatgtttcatgctacagtggctacgcagacacagttctttcatgtgaaggttttaaacatcaacttgaagaggaaattcattaaaaagagaatcatcattatatcaaattattccaaacgtaatagtctcctagaggtgaatgaagcctcttctgtatctgaagctggtcctgaccaaacgtttgaggttccaaaggacatcatcagaagagcaaagaaaattccgaagatcaatattcttcacaaacaaacttcaggatatattgtatatggattatttatgctacatacgaaaattgtaaataggaagacgacaatctatgaaattcaggataaaacaggaagtatggctgtagtaggaaaaggagaatgccacaatatcccctgtgaaaaaggagataagcttcgactcttctgctttcgactgagaaagagggaaaatatgtcaaaactgatgtcagaaatgcatagtttcatccagatacagaaaaatacaaaccagagaagccatgactccaggagcatggcactaccccaggaacagagtcagcatccaaaaccttcagaggccagcacaaccctacctgaaagccatctcaagactcctcagatgccaccaacaaccccatccagcagttccttcaccaagaaggatgaaacccacccaggagcacagtcatcgcctgcaaactttagaatcacctcaccaactgtggcccctcctctttcttctgacacttccaccaaccgccatccagcagttccttaaataaggtcaccaaggacaaggatatcaaataac

SEQ ID NO: 172674 - DNA, 2083 bp, Homo sapiens
  Payload ID: 13946
  Gene Symbol: PYHIN1
  Gene Name: pyrin and HIN domain family, member 1
  Uniprot ID: Q6K0P9
  ENST ID: ENST00000368140
  CDS Start-End: 246-1724
agagtatgaggaagccagcactagtcaagtgactctaagaagggccattttcccttgttgtctttgaaaatacttcattttcttagcatttcaggagattataacatcctgtatttcagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagttgcaaataaaattgaatccattccagtcaaaggaataatcccatctaaaaagacgaaacagaaagaagtgtatcctgctacacctgcatgcaccccaagcaaccgtctcacagctaaaggagcagaggagactcttggacctcagaaaagaaaaaaaccatctgaagaagagactggaaccaaaaggagtaagatgtccaaagagcagactcggccttcctgctctgcaggagccagcacgtccacagccatgggccgttccccacctccccagacctcatcatcagctccacccaacacttcctcaactgagagcctaaaaccattggccaaccgtcacgcaactgccagtaaaaatattttccgagaagacccaataatcgcgatggtactaaatgcaacaaaagtatttaaatatgaatcctcagaaaatgagcaaagaagaatgtttcatgctacagtggctacgcagacacagttctttcatgtgaaggttttaaacatcaacttgaagaggaaattcattaaaaagagaatcatcattatatcaaattattccaaacgtaatagtctcctagaggtgaatgaagcctcttctgtatctgaagctggtcctgaccaaacgtttgaggttccaaaggacatcatcagaagagcaaagaaaattccgaagatcaatattcttcacaaacaaacttcaggatatattgtatatggattatttatgctacatacgaaaattgtaaataggaagacgacaatctatgaaattcaggataaaacaggaagtatggctgtagtaggaaaaggagaatgccacaatatcccctgtgaaaaaggagataagcttcgactcttctgctttcgactgagaaagagggaaaatatgtcaaaactgatgtcagaaatgcatagtttcatccagatacagaaaaatacaaaccagagaagccatgactccaggagcatggcactaccccaggaacagagtcagcatccaaaaccttcagaggccagcacaaccctacctgaaagccatctcaagactcctcagatgccaccaacaaccccatccagcagttccttcaccaagaaggatgaaacccacccaggagcacagtcatcgcctgcaaactttagaatcacctcaccaactgtggcccctcctctttcttctgacacttccaccaaccgccatccagcagttccttaaataaggtcaccaaggacaaggatatcaaataactactgttcaatctttactcaagtgtggaaattttgcctgaagtcctccacctaaaaacctgatgccattggtaatgatgtttatgaagataagatcaaagcacagaaaataatatatgtatatatatctggttgaaatactatatatatatatatatatatatatatatatatatatatatatatataccagctattaattctaggaaatggagtattaagggtgcattttatttcattagttttacttttatgcattttcttcatatcatattttgcattcagaattttcataatttgaaaaaaaataaacttttttttcttaaa

SEQ ID NO: 172675 - DNA, 1597 bp, Homo sapiens
  Payload ID: 13946
  Gene Symbol: PYHIN1
  Gene Name: pyrin and HIN domain family, member 1
  Uniprot ID: Q6K0P9
  ENST ID: ENST00000392252
  CDS Start-End: 238-1596
aggaagccagcactagtcaagtgactctaagaagggccattttcccttgttgtctttgaaaatacttcattttcttagcatttcaggagattataacatcctgtatttcagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagtcaaaggaataatcccatctaaaaagacgaaacagaaagaagtgtatcctgctacacctgcatgcaccccaagcaaccgtctcacagctaaaggagcagaggagactcttggacctcagaaaagaaaaaaaccatctgaagaagagactggaaccaaaaggagtaagatgtccaaagagcagactcggccttcctgctctgcaggagccagcacgtccacagccatgggccgttccccacctccccagacctcatcatcagctccacccaacacttcctcaactgagagcctaaaaccattggccaaccgtcacgcaactgccagtaaaaatattttccgagaagacccaataatcgcgatggtactaaatgcaacaaaagtatttaaatatgaatcctcagaaaatgagcaaagaagaatgtttcatgctacagtggctacgcagacacagttctttcatgtgaaggttttaaacatcaacttgaagaggaaattcattaaaaagagaatcatcattatatcaaattattccaaacgtaatagtctcctagaggtgaatgaagcctcttctgtatctgaagctggtcctgaccaaacgtttgaggttccaaaggacatcatcagaagagcaaagaaaattccgaagatcaatattcttcacaaacaaacttcaggatatattgtatatggattatttatgctacatacgaaaattgtaaataggaagacgacaatctatgaaattcaggataaaacaggaagtatggctgtagtaggaaaaggagaatgccacaatatcccctgtgaaaaaggagataagcttcgactcttctgctttcgactgagaaagagggaaaatatgtcaaaactgatgtcagaaatgcatagtttcatccagatacagaaaaatacaaaccagagaagccatgactccaggagcatggcactaccccaggaacagagtcagcatccaaaaccttcagaggccagcacaaccctacctgaaagccatctcaagactcctcagatgccaccaacaaccccatccagcagttccttcaccaaggtcaccaaggacaaggatatcaaataac

SEQ ID NO: 172676 - DNA, 1624 bp, Homo sapiens
  Payload ID: 13946
  Gene Symbol: PYHIN1
  Gene Name: pyrin and HIN domain family, member 1
  Uniprot ID: Q6K0P9
  ENST ID: ENST00000392254
  CDS Start-End: 238-1623
aggaagccagcactagtcaagtgactctaagaagggccattttcccttgttgtctttgaaaatacttcattttcttagcatttcaggagattataacatcctgtatttcagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagttgcaaataaaattgaatccattccagtcaaaggaataatcccatctaaaaagacgaaacagaaagaagtgtatcctgctacacctgcatgcaccccaagcaaccgtctcacagctaaaggagcagaggagactcttggacctcagaaaagaaaaaaaccatctgaagaagagactggaaccaaaaggagtaagatgtccaaagagcagactcggccttcctgctctgcaggagccagcacgtccacagccatgggccgttccccacctccccagacctcatcatcagctccacccaacacttcctcaactgagagcctaaaaccattggccaaccgtcacgcaactgccagtaaaaatattttccgagaagacccaataatcgcgatggtactaaatgcaacaaaagtatttaaatatgaatcctcagaaaatgagcaaagaagaatgtttcatgctacagtggctacgcagacacagttctttcatgtgaaggttttaaacatcaacttgaagaggaaattcattaaaaagagaatcatcattatatcaaattattccaaacgtaatagtctcctagaggtgaatgaagcctcttctgtatctgaagctggtcctgaccaaacgtttgaggttccaaaggacatcatcagaagagcaaagaaaattccgaagatcaatattcttcacaaacaaacttcaggatatattgtatatggattatttatgctacatacgaaaattgtaaataggaagacgacaatctatgaaattcaggataaaacaggaagtatggctgtagtaggaaaaggagaatgccacaatatcccctgtgaaaaaggagataagcttcgactcttctgctttcgactgagaaagagggaaaatatgtcaaaactgatgtcagaaatgcatagtttcatccagatacagaaaaatacaaaccagagaagccatgactccaggagcatggcactaccccaggaacagagtcagcatccaaaaccttcagaggccagcacaaccctacctgaaagccatctcaagactcctcagatgccaccaacaaccccatccagcagttccttcaccaaggtcaccaaggacaaggatatcaaataac

SEQ ID NO: 172677 - DNA, 771 bp, Homo sapiens
  Payload ID: 13946
  Gene Symbol: PYHIN1
  Gene Name: pyrin and HIN domain family, member 1
  ENST ID: ENST00000458222
  CDS Start-End: 320-771
gacacccactgcccttaacagaaaaaatactgctgagcaaagggtttaacaggactctcggtctaccagaagttcagtgcattttccaggattttcaaggcttcgatgctgtcatgttgtgagcccactatccacttgtgtttttccatgaataatgaaggaaacctgaggaatcatgaatgtaatcattgagtttctgagagctttactgactgatttccctattcaaaacaatcctcatttcctacatttctgaagatctcaagatctggactactgttgaagaaattcccagtaaggctcacttatatctttagagatggcaaataactacaagaaaattgttctactgaaaggattagaggtcatcaatgattatcattttagaattgttaagtccttactgagtaacgatttaaaacttaatccaaaaatgaaagaagagtatgacaaaattcagattgctgacttgatggaggaaaagttcccaggtgatgccggtttgggcaaactaatagaattcttcaaagaaataccaacactgggagaccttgctgaaactcttaaaagagaaaagttaaaagttgcaaataaaattgaatccattccagtcaaaggaataatcccatctaaaaagacgaaacagaaagaagtgtatcctgctacacctgcatgcaccccaagcaaccgtctcacagctaaaggagcagaggagactcttggacctcagaaaagaaaaaaaccatctgaagaagagactggaaccaaaag

SEQ ID NO: 172678 - DNA, 294 bp, Homo sapiens
  Payload ID: 13947
  Gene Symbol: PYDC2
  Gene Name: pyrin domain containing 2
  Uniprot ID: Q56P42
  ENST ID: ENST00000518817
  CDS Start-End: 1-294
atggcatcttctgcagagctggacttcaacctgcaggctcttctggagcagctcagccaggatgagttgagcaagttcaagtctctgatcagaacaatctccctgggaaaggagctacagaccgtcccccagacagaggtagacaaggctaatgggaagcaactggtagaaatcttcaccagccactcctgcagctactgggcagggatggcagccatccaggtctttgaaaagatgaatcaaacgcatctgtctgggagagctgatgaacactgtgtgatgcccccaccttaa

SEQ ID NO: 172679 - DNA, 411 bp, Homo sapiens
  Payload ID: 13948
  Gene Symbol: QRFP
  Gene Name: pyroglutamylated RFamide peptide
  Uniprot ID: P83859
  ENST ID: ENST00000343079
  CDS Start-End: 1-411
atggtaaggccttaccccctgatctacttcctcttcctgccgctgggcgcctgcttccctctactggacagaagagagcccacagacgccatgggtggcctcggagctggagaacgctgggccgacctggccatggggccccgaccccactccgtgtggggttcctctcggtggctgagagcttcacagccacaggccctgcttgtcatagccagggggctgcagacatcgggcagagagcatgctggctgcagattccgcttcgggaggcaggacgaaggcagtgaggccaccggcttcctccctgctgcgggggagaagaccagcggcccgttagggaacctggctgaggagctcaatggctacagcaggaagaaaggcggcttcagcttccgcttcggtcggcggtga

SEQ ID NO: 172680 - DNA, 1658 bp, Homo sapiens
  Payload ID: 13948
  Gene Symbol: QRFP
  Gene Name: pyroglutamylated RFamide peptide
  Uniprot ID: P83859
  ENST ID: ENST00000623824
  CDS Start-End: 522-932
cacaggacaggggcacctcaggccatcggaggcagccctggcctgggggatggaagctggttctggccagcaaagctcagtcatcggcttcaatccgcagaccctccgcccgaacctgggcgctcagccccgaagtggaggatcgagattccagtgccttcctcaggtctctggggaagtgtccacaggctctctattcccatgacttctgatcccccagcagccgggatgcagggggcagcccgcctgccctctcatcagactacatcctgtgtgaggttgtttttatcaacgcggtcagcactgcccctcttcaacaacagcgtccccaatggaatcccagggtcaggaatgcgcagcaggcagtcggcagagcagcaagcgcaccgcgggccatataaagcagggagagcccaggggccatgcctcctggacgaggacccagagcagctctgcccagcccagccccggagcccagcgatccaccagccagccttcctgggagcagtcccagccacacgatggtaaggccttaccccctgatctacttcctcttcctgccgctgggcgcctgcttccctctactggacagaagagagcccacagacgccatgggtggcctcggagctggagaacgctgggccgacctggccatggggccccgaccccactccgtgtggggttcctctcggtggctgagagcttcacagccacaggccctgcttgtcatagccagggggctgcagacatcgggcagagagcatgctggctgcagattccgcttcgggaggcaggacgaaggcagtgaggccaccggcttcctccctgctgcgggggagaagaccagcggcccgttagggaacctggctgaggagctcaatggctacagcaggaagaaaggcggcttcagcttccgcttcggtcggcggtgaagggccaggacgccttggaaggatttgcttcttggactcacccccattgtcttcactcctgccttctcccccagtctcaaagaccacgacacccagatgatgtaggcttggttacgatgaacgatccatggtaggacaggttaggtgtgtgcttacttttgatttccaactttgctgaagcgaaaaactaggcagtgtcaaaaaggaggctgtcttggagcctcggtcgtcccagcctctctcttcccctggggctttgactccgagcagccccctggccccaggggcacggagctgaggctgtggctgggccatgagtgtgaatagcagagcgaggcagcgggctgagtgcttacagttgggtaatcaaagttgtgacagtctctataggcacgactgcggctgacatcagagtgcaaatgagtgcattccactgggtacagaggatggttctgaaagttaaaaatgggaaaaaagaacccgatccccttctccatgccatgagcacaagatccccctggcaagaagcccctgctgtggtttgcctgcccctctgaccgcagcccttctccgcggcccagtgttagcccggccaggagtctcctgggagatgcgttgggaaggaatcccgtttttgctatagcaaggttgcatttcacatgttcaaaatcagaatatgtcgtgtgtatcttttcaaataaaagttgtgacaactgcaaaaccata

SEQ ID NO: 172681 - DNA, 1215 bp, Homo sapiens
  Payload ID: 13949
  Gene Symbol: QRFPR
  Gene Name: pyroglutamylated RFamide peptide receptor
  ENST ID: ENST00000334383
  CDS Start-End: 33-809
gcggtggccccgcgtcccgggagcgcacagcaatgcaggcgcttaacattaccccggagcagttctctcggctgctgcgggaccacaacctgacgcgggagcagttcatcgctctgtaccggctgcgaccgctcgtctacaccccagagctgccgggacgcgccaagctggccctcgtgctcaccggcgtgctcatcttcgccctggcgctctttggcaatgctctggtgttctacgtggtgacccgcagcaaggccatgcgcaccgtcaccaacatctttatctgctccttggcgctcagtgacctgctcatcaccttcttctgcattcccgtcaccatgctccagaacatttccgacaactggctggggggtgctttcatttgcaagatggtgccatttgtccagtctaccgctgttgtgacagaaatcctcactatgacctgcattgctgtggaaaggcaccagggacttgtgcatccttttaaaatgaagtggcaatacaccaaccgaagggctttcacaatgctaggtgtggtctggctggtggcagtcatcgtaggatcacccatgtggcacgtgcaacaacttgagatcaaatatgacttcctatatgaaaaggaacacatctgctgcttagaagagtggaccagccctgtgcaccagaagatctacaccaccttcatccttgtcatcctcttcctcctgcctcttatggaagaagaaacgagctgtcattatgatggtgacagtggtggctctctttgctgtgtgctgggcaccattccatgttgtccatatgatgattgaatacagtaattttgaaaaggaatatgatgatgtcacaatcaagatgatttttgctatcgtgcaaattattggattttccaactccatctgtaatcccattgtctatgcatttatgaatgaaaacttcaaaaaaaatgttttgtctgcagtttgttattgcatagtaaataaaaccttctctccagcacaaaggcatggaaattcaggaattacaatgatgcggaagaaagcaaagttttccctcagagagaatccagtggaggaaaccaaaggagaagcattcagtgatggcaacattgaagtcaaattgtgtgaacagacagaggagaagaaaaagctcaaacgacatcttgctctctttaggtctgaactggctgagaattctcctttagacagtgggcattaa

SEQ ID NO: 172682 - DNA, 1708 bp, Homo sapiens
  Payload ID: 13949
  Gene Symbol: QRFPR
  Gene Name: pyroglutamylated RFamide peptide receptor
  Uniprot ID: Q96P65
  ENST ID: ENST00000394427
  CDS Start-End: 413-1708
accctccaccgctccccaagcgggtccggcgtccgcatcgcatggccagaaggcggggagccagaggcgccaggaccctcgcgtggcgctccagcaccccagaccgtggcggcgcctcgccttagggaagagcaagggaagaactttatttgaaccgcgaacattttttggtcactgagatcgagtctcccagtgctttggcttcccgcctctttatcgtgggtttgatccctgagctgctctcctttcccgaacctcccggggtgcagcctagagccctcccgcgcggctgactccagagtagaggaagggaggcggcctccggctggtcccccgaagccctcgctgccccgcagatgcggatggccagccagtagcgggcggtggccccgcgtcccgggagcgcacagcaatgcaggcgcttaacattaccccggagcagttctctcggctgctgcgggaccacaacctgacgcgggagcagttcatcgctctgtaccggctgcgaccgctcgtctacaccccagagctgccgggacgcgccaagctggccctcgtgctcaccggcgtgctcatcttcgccctggcgctctttggcaatgctctggtgttctacgtggtgacccgcagcaaggccatgcgcaccgtcaccaacatctttatctgctccttggcgctcagtgacctgctcatcaccttcttctgcattcccgtcaccatgctccagaacatttccgacaactggctggggggtgctttcatttgcaagatggtgccatttgtccagtctaccgctgttgtgacagaaatcctcactatgacctgcattgctgtggaaaggcaccagggacttgtgcatccttttaaaatgaagtggcaatacaccaaccgaagggctttcacaatgctaggtgtggtctggctggtggcagtcatcgtaggatcacccatgtggcacgtgcaacaacttgagatcaaatatgacttcctatatgaaaaggaacacatctgctgcttagaagagtggaccagccctgtgcaccagaagatctacaccaccttcatccttgtcatcctcttcctcctgcctcttatggtgatgcttattctgtacagtaaaattggttatgaactttggataaagaaaagagttggggatggttcagtgcttcgaactattcatggaaaagaaatgtccaaaatagccaggaagaagaaacgagctgtcattatgatggtgacagtggtggctctctttgctgtgtgctgggcaccattccatgttgtccatatgatgattgaatacagtaattttgaaaaggaatatgatgatgtcacaatcaagatgatttttgctatcgtgcaaattattggattttccaactccatctgtaatcccattgtctatgcatttatgaatgaaaacttcaaaaaaaatgttttgtctgcagtttgttattgcatagtaaataaaaccttctctccagcacaaaggcatggaaattcaggaattacaatgatgcggaagaaagcaaagttttccctcagagagaatccagtggaggaaaccaaaggagaagcattcagtgatggcaacattgaagtcaaattgtgtgaacagacagaggagaagaaaaagctcaaacgacatcttgctctctttaggtctgaactggctgagaattctcctttagacagtgggcattaa

SEQ ID NO: 172683 - DNA, 1429 bp, Homo sapiens
  Payload ID: 13949
  Gene Symbol: QRFPR
  Gene Name: pyroglutamylated RFamide peptide receptor
  ENST ID: ENST00000507331
  CDS Start-End: 1-573
atgcaggcgcttaacattaccccggagcagttctctcggctgctgcgggaccacaacctgacgcgggagcagttcatcgctctgtaccggctgcgaccgctcgtctacaccccagagctgccgggacgcgccaagctggccctcgtgctcaccggcgtgctcatcttcgccctggcgctctttggcaatgctctggtgttctacgtggtgacccgcagcaaggccatgcgcaccgtcaccaacatctttatctgctccttggcgctcagtgacctgctcatcaccttcttctgcattcccgtcaccatgctccagaacatttccgacaactggctggggggtgctttcatttgcaagatggtgccatttgtccagtctaccgctgttgtgacagaaatcctcactatgacctgcattgctgtggaaaggcaccagggacttgtgcatccttttaaaatgaagtggcaatacaccaaccgaagggctttcacaatgctaggtgtggtctggctggtggcagtcatcgtaggatcacccatgtggcacgtgcaacaacttgaggctttaccctgaatagaaatatatttaagagagagaagagcacaaagccctgccatgtgtttatgatgccttgatcaatgtggcttcactgacatcagtcattgaattatgtcttgttttggtgccccgtgatcaaatatgacttcctatatgaaaaggaacacatctgctgcttagaagagtggaccagccctgtgcaccagaagatctacaccaccttcatccttgtcatcctcttcctcctgcctcttatggtgatgcttattctgtacagtaaaattggttatgaactttggataaagaaaagagttggggatggttcagtgcttcgaactattcatggaaaagaaatgtccaaaatagccaggaagaagaaacgagctgtcattatgatggtgacagtggtggctctctttgctgtgtgctgggcaccattccatgttgtccatatgatgattgaatacagtaattttgaaaaggaatatgatgatgtcacaatcaagatgatttttgctatcgtgcaaattattggattttccaactccatctgtaatcccattgtctatgcatttatgaatgaaaacttcaaaaaaaatgttttgtctgcagtttgttattgcatagtaaataaaaccttctctccagcacaaaggcatggaaattcaggaattacaatgatgcggaagaaagcaaagttttccctcagagagaatccagtggaggaaaccaaaggagaagcattcagtgatggcaacattgaagtcaaattgtgtgaacagacagaggagaagaaaaagctcaaacgacatcttgctctctttaggtctgaactggctgagaattctcctttagacagtgggcattaatt

SEQ ID NO: 172684 - DNA, 1409 bp, Homo sapiens
  Payload ID: 13950
  Gene Symbol: PGPEP1
  Gene Name: pyroglutamyl-peptidase I
  Uniprot ID: Q9NXJ5
  ENST ID: ENST00000252813
  CDS Start-End: 252-650
gagaggctgcagcggcagcagctgtcgcgccagtcgcaacagaagcaggtccgaggcacagcccgatcccgccatggagcagccgaggaaggcggtggtagtgacgggagctagaaaagctaggccttggcgacagcgtggacctgcatgtgtacgagattccggttgagtaccaaacagtccagagactcatccccgccctgtgggagaagcacagtccacagctggtggtgcatgtgggggtgtcaggcatggcgaccacagtcacactggagaaatgtggacacaacaagggctacaaggggctggacaactgccgcttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcagatatctctgcgactttacctactacacctctttgtaccagagtcacggtcgatcagccttcgtccacgtgcccccactggggaagccgtacaacgcggaccagctgggcagggcactgagagccatcattgaggagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttcagcttggggatccgatctggaagagagattctgatctgcccacctcctcttcctccttctctacaaaagctccggttgattcgagggaagtggtgaaaatttttttttctcccattttcctccctgcatctggggacacagctgccgtgaccagggaggccagcctgggaggtccagatgcccagggagaatcttggtctggtgaatccatgagctgcgataccacggctggggccatatgttcacctgctttcctgtccgttggtgaaggaatttcagaattcattttatatccaagactggcttttaccaaatttaaaagcctctcaatgcgtcctcgaccttgaactgtgctcaacagcctggccctttctggggccaccctgggatatggctggctggctggctttctttctttctttctttctttctttcttgctttctttctttcttgctttctttcttctctctctctctttttttttttttttaaatagtgctagtttgggcacagagtaatttatattccctttggttaaaatgcaggctttttagccaacaacaaaagtgttttccccccacccccactcgcccaccagggtgatgccacttttgcctcctgccctgaaaattggacttaagatgccatgtcttggccaggcgca

SEQ ID NO: 172685 - DNA, 7092 bp, Homo sapiens
  Payload ID: 13950
  Gene Symbol: PGPEP1
  Gene Name: pyroglutamyl-peptidase I
  Uniprot ID: Q9NXJ5
  ENST ID: ENST00000269919
  CDS Start-End: 96-725
aggggcgtggcctcgcgcggccgagaggctgcagcggcagcagctgtcgcgccagtcgcaacagaagcaggtccgaggcacagcccgatcccgccatggagcagccgaggaaggcggtggtagtgacgggatttggcccttttggggaacacaccgtgaacgccagttggattgcagttcaggagctagaaaagctaggccttggcgacagcgtggacctgcatgtgtacgagattccggttgagtaccaaacagtccagagactcatccccgccctgtgggagaagcacagtccacagctggtggtgcatgtgggggtgtcaggcatggcgaccacagtcacactggagaaatgtggacacaacaagggctacaaggggctggacaactgccgcttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcagatatctctgcgactttacctactacacctctttgtaccagagtcacggtcgatcagccttcgtccacgtgcccccactggggaagccgtacaacgcggaccagctgggcagggcactgagagccatcattgaggagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttcagcttggggatccgatctggaagagagattctgatctgcccacctcctcttcctccttctctacaaaagctccggttgattcgagggaagtggtgaaaatttttttttctcccattttcctccctgcatctggggacacagctgccgtgaccagggaggccagcctgggaggtccagatgcccagggagaatcttggtctggtgaatccatgagctgcgataccacggctggggccatatgttcacctgctttcctgtccgttggtgaaggaatttcagaattcattttatatccaagactggcttttaccaaatttaaaagcctctcaatgcgtcctcgaccttgaactgtgctcaacagcctggccctttctggggccaccctgggatatggctggctggctggctttctttctttctttctttctttctttcttgctttctttctttcttgctttctttcttctctctctctctttttttttttttttaaatagtgctagtttgggcacagagtaatttatattccctttggttaaaatgcaggctttttagccaacaacaaaagtgttttccccccacccccactcgcccaccagggtgatgccacttttgcctcctgccctgaaaattggacttaagatgccatgtcttggccaggcgcagtggctcatgcctgtaatcccagcactttggaaggccagggtgggcggatcacctgagatcaggagttcaagatcagcctggccaacatggtgaaaccctgcctctactaaaaatacaaaaattagccgggcatggtgatgagtgcctgtagtcccagctactcgggaggctgaggctggagaatcgcttgaacttgggaggcagaggttgcagtgagctgagattgcacagctgcactccagcctgggtgacagagcgagactctgtctcaaaacaattggacttaagatggcatgtctttgttttagggccaaaaatgaggcccccttgcttaaggcatggggtccgtggccaggcaacggggtgggactgctgccccagatgtggccatgggggtcgtggtcctttcaacaccaagctatgagctgtcgccatggagaccagggccacctgtggaaaggcggattttgtctgcttttgacttttcttttttaatatgtaaaactccacatcagcggaaacccccccctacttctggcctggagcttcagggttttggtgctgggacgagtttgttgttctccttagcggggtggcgcggggggctcaaaacgggggcgcgggggctggagttggcagagctctgcatgtcccggcatgtctgagcaggaggaattccgggcggccaaagggttttatgtagattgcttttggacactcgcccaggagtcaggagttgatttttatctcacttcctggtaaccttgaacttaccaggcagggatgagatgacgtaaacttcctcagatgatgtaagttcagccacatcttgctgcccattagggagagaggacgacccccacagtgaaagtaattgagtgaaatgcacgttctggaaatcagtttctattttggcctggaggaatgtggctatactgcttccctgagtgtgacacagttggaatctaatcttgttggtttcccaacatctaggtttttgtttgtttgtttgtttttatgatagggtcttgttctgttgaccaggctggagtacagtagtgtgatcatggatcactgcagcctctacctcctgggctcaagtgatcctcccatctcagcctcctgagtagctgggactacaggcatgcaccaccacacctggctaatttttaaattttttatacagacagggtttcaccatgttgcccaggctggtctcgaactcctggactcaaactgatcctcctttctcggcctcccaaagtgctgggattacaggcatgagccactgcacccagcccagttctttcttaaaacagctgagagttttgttttcttcagcgttcaccttccttgtctccagttccgatgctggcagtggttcctacctctgttgggtttctagatagtttgggaacggggttgatgggtttctgtgaaacacattttccaagtcttgggctttctctggaggggaaggtggatgctggcgggtgacttgcagtgggcgcctggcagtgggtgtggactgtaactgacaggtggaaatgagtagggacactattgttccctccatgccagcttttttttttgctggaaatgccccctccacacccctggtagctctgtgtcctgagaaatccagagtgtgggagacatcactgcatctgtccccccagcttctgtgaagggaagctgtggcctcttttgaatgtggggaacaactgaagactcaggggtcacccagaggtctggtggaaagcaacttcaggtttcatcttgctctattcctcaaaggtctggtctgtgggcctctgaggagaaaacaggtctagccaagacagggacaaaatggggaaggggatgtgccaggcctgaactgagctaagcacctgccccgggctccacacttccatctttcttttgtcttcatttcacctctgtgtttaaagcactgtgtgacatagctccttagagatataacctattgtctgctcattgtcacgtgtgtgtgtgtcatctttgtattcttgcagtggtttcacatttccttacccagtcaagccagtatcccatccttcctcataatgcacaacatttggctcattttatttttctcattgttattttttatttttattttttgagatggattctcacactgttactcgggctagagtgcaatggcgtgatctcggctcactgcaacctccacctcctgggtttacacaattctcctgcctcagcctcccgagtagctgggattacaggcgcccgtcaccacacctggctaatttttgtatttttagtagagatgcagcttcaccatgttggccaggctggtcttgaaatcctgacctcaggtgatctgcctgccttggcctcccaaagtgctgggattacaggtgtgagctactgcgcctggccaagttttttacaaatatttttcttttggtggaactcatctgtgcactctctggtgtgtttttccacctttgttgggtcttggcttaaaatatcctcatgtgggctaggtgtggttactcacacctgtaatcctagcactttgggaggttgaggcaggagaatcccttgagccaggagttcaagaccagcctgggcaacatagcaagagatcccatatctaccaaaacatacaagaattagccagatgtggtggtgcatgcctgtggtcccagatactcaggaggctgaggcaggaggatcacctatgcctgggaggttgaagccccagtgagccatgatcacaccactgtagtccagcccgggtgacacagcaagactctgtctcaaaaaaaaaaaaaaaaaaaatcctcatgcaagaagggaaggaccaagtcccattccctcttgcctcattttcagagcctggggtaggggctacaggtggcataggaagggtctgcaaggtgggtgggacttggcaggtgttgggaagaggaataggggtggcaagtgtcaatggtgaaaagacaggctgaggggtgtggtgggaaggctgggggagaaaggtgagaagtgattgggggggcttccctgatgagtcctcatggagggtgctgaggcagggaacaggggtgcagggacagtgatcagggcacctggtaccctgaccaacttgatgatggcatctcttttaagatgcccaagtctgcgcacttttattcctttattcggcccctagcaccccctccccaccccaaagaaggtcagttgcatgcgtgtggggatgtagctcaaaaaagaaataagatggagtggaaaggaaagaaaggaagaagcaggaattcaaggtgggtgggctgagcttggggccacctagcccacctgctccaatcaagggctggaacaaacctgaggccacttggagaggcagggctgggcagggacagggggtgggggccgaaatcacagcttccccatcagagccagatgtgtgaaggaaatgtcccagatggcagtagtttctcggcaaggaggggaatcctggagatggttcatgtctgtgatcccagtgctttgggaggctgaggtgggaggattgcttgagcccgggagttcgagaccagccctgggcaacatggcgagaccccatctctacagaaattaaaaaaaaaaattagccagttgtggtgtcaagcacctgtagtcccagctacttgggaggctgagttgggaggcttatctgagcccaggaggtgaaggctgcaatgagccatgattacactactgtaccccagcctgggcaacagagcaagaccctgcctcaaaattaagaaaaaaaaaaggggggccaggcgcagtggcttatgcctgttatcccagcactttgggaggccaaggcagactgatcgcttgaggccaggagtttgcgaccagcctggccaacatagcaaaaccccatctctactaaaaatacaaaaattagtcaagagtggatggtgcgtgcctgtaatcccagctacctgggaggctgagacaggagaattgcttgaacctgggaggcagaggttgcagtggtgtgagatcacgccactgcattccagactgggcaacatagcaagactctgtcacaaaaaaaaaaaaaaaaaagaattccctgctctgcttttctgctcgttgctggcatagaaacatctagaacagaaagtatccactctggggcagatgggagagctggaaaagtagattcaagatgccttttagtcttggaagtttcttccaggaagcaagaccagctggtatgtttacacctgcactccagtgccctggggaggtgaccaggtggagggggatggctcatggaaatctgtcccgcacagctggcccccttttggctgccactgtctagactgttggcctttgacctctctgcctcttgtggcgtctgaacctagacgtcccttttggagacagctggacaaagccctattctccgcagccccagcctctatcctgaggcctctgggagctgcgtgacggccagcatggggtgctgatcatggtcaaggaggcaggtctttgccaggttgccccatgcagccacccatcctcagcatcctaacttgagggggcaggagagggctttgtttttataatccggattaaatttcccttccctgggcacaagtgcctcatgagggcccggggctgctggttgggagggaaagcatccccgtttttgcagtgaggaggccggccgagggctggggttccacttagacccttggcagaatggctgttgaggggcaggcgctgcccagtgcccacgtctggaaagctaattcccgggtggacgctgaacatacctgctgagagactctgtcccctggtttccaggacagttgtcacaagctgagtggggggggactcccaggacttgagggacccagtcccaccccaaactgctccccctcccccaaattccctttctcctcctgctctttctccccgctgtgcctcccccagttacccacagaagtgcctgcctctccagcgctcacagaacacacaaaaagggacaggaattggtcactgggtagtggccgtggctcctgacgatccagaccagcgtctggcccaagccattcagaggtggggtctggggcctgggggttttgtgtcgtgacactttgtctcaaggagattccacatagggatttgaattaggctttctgcttgccaaggcctgtggcatctgagcctggctgagggccgggcaagcctcccctgagcctttggaagccgagttcactctctgcctgcccaggggagcaccggcttggttctgggggctcctctaacatctcaggtttttatcttgtcttaaatttctttctaggaaaaaacccttccctgccaaaggtgactgtgttttctgccgccgaaggagggcccggtccctccaggctcagtgtggcttctccctgacccccgccctagaacttttgccagtgccttttctgaaactcctgtgtcccgggccccccaggcggagaaggatatgccggattctgcctggggctgggctctaggagaccccaaatttgacaccacagaaagcaaataaaacacttgaaatacgca

SEQ ID NO: 172686 - DNA, 1414 bp, Homo sapiens
  Payload ID: 13950
  Gene Symbol: PGPEP1
  Gene Name: pyroglutamyl-peptidase I
  ENST ID: ENST00000600283
  CDS Start-End: 69-338
gctgcagcggcagcagctgtcgcgccagtcgcaacagaagcaggtccgaggcacagcccgatcccgccatggagcagccgaggaaggcggtggtagtgacgggatttggcccttttggggaacacaccgtgaacgccagttggattgcagttcagagatgggatctcactatattgccctggctggtcttgaacttccgggctcaaatgatccttccacctcggcctcccaaagaagctgggattataggtgtgagccaccgagccctgccatcaggagctagaaaagctaggccttggcgacagcgtggacctgcatgtgtacgagattccggttgagtaccaaacagtccagagactcatccccgccctgtgggagaagcacagtccacagctggtggtgcatgtgggggtgtcaggcatggcgaccacagtcacactggagaaatgtggacacaacaagggctacaaggggctggacaactgccgcttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcagagtcacggtcgatcagccttcgtccacgtgcccccactggggaagccgtacaacgcggaccagctgggcagggcactgagagccatcattgaggagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttcagcttggggatccgatctggaagagagattctgatctgcccacctcctcttcctccttctctacaaaagctccggttgattcgagggaagtggtgaaaatttttttttctcccattttcctccctgcatctggggacacagctgccgtgaccagggaggccagcctgggaggtccagatgcccagggagaatcttggtctggtgaatccatgagctgcgataccacggctggggccatatgttcacctgctttcctgtccgttggtgaaggaatttcagaattcattttatatccaagactggcttttaccaaatttaaaagcctctcaatgcgtcctcgaccttgaactgtgctcaacagcctggccctttctggggccaccctgggatatggctggctggctggctttctttctttctttctttctttctttcttgctttctttctttcttgctttctttcttctctctctctctttttttttttttttaaatagtgctagtttgggcacagagtaatttatattccctttggttaaaa

SEQ ID NO: 172687 - DNA, 1237 bp, Homo sapiens
  Payload ID: 13950
  Gene Symbol: PGPEP1
  Gene Name: pyroglutamyl-peptidase I
  ENST ID: ENST00000596962
  CDS Start-End: 72-341
gaggctgcagcggcagcagctgtcgcgccagtcgcaacagaagcaggtccgaggcacagcccgatcccgccatggagcagccgaggaaggcggtggtagtgacgggatttggcccttttggggaacacaccgtgaacgccagttggattgcagttcagagatgggatctcactatattgccctggctggtcttgaacttccgggctcaaatgatccttccacctcggcctcccaaagaagctgggattataggtgtgagccaccgagccctgccatcaggagctagaaaagctaggccttggcgacagcgtggacctgcatgtgtacgagattccggttgagtaccaaacagtccagagactcatccccgccctgtgggagaagcacagtccacagctggtggtgcatgtgggggtgtcaggcatggcgaccacagtcacactggagaaatgtggacacaacaagggctacaaggggctggacaactgccgcttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcagatatctctgcgactttacctactacacctctttgtaccagagtcacggtcgatcagccttcgtccacgtgcccccactggggaagccgtacaacgcggaccagctgggcagggcactgagagccatcattgaggagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttcagcttggggatccgatctggaagagagattctgatctgcccacctcctcttcctccttctctacaaaagctccggttgattcgagggaagtggtgaaaatttttttttctcccattttcctccctgcatctggggacacagctgccgtgaccagggaggccagcctgggaggtccagatgcccagggagaatcttggtctggtgaatccatgagctgcgataccacggctggggccatatgttcacctgctttcctgtccgttggtgaaggaatttcagaattcattttatatccaagactggcttttaccaaatttaaaa

SEQ ID NO: 172688 - DNA, 418 bp, Homo sapiens
  Payload ID: 13950
  Gene Symbol: PGPEP1
  Gene Name: pyroglutamyl-peptidase I
  ENST ID: ENST00000595552
  CDS Start-End: 1-264
gaggacgggcctgaaagcattgactccatcatcgacatggatgctgtgtgcaagcgagtcaccacgttgggcctggatgtgtcggtgaccatctcgcaggatgccggcagccttggaagtcagaagtccaaggtcaaggtggtagcaggactggttccttctggaggtgctgagggaaaaaacccttccctgccaaaggtgactgtgttttctgccgccgaaggagggcccggtccctccaggctcagtgtggcttctccctgacccccgccctagaacttttgccagtgccttttctgaaactcctgtgtcccgggccccccaggcggagaaggatatgccggattctgcctggggctgggctctaggagaccccaaatttgacaccacagaaagcaaataaaacacttgaaatacg

SEQ ID NO: 172689 - DNA, 363 bp, Homo sapiens
  Payload ID: 13950
  Gene Symbol: PGPEP1
  Gene Name: pyroglutamyl-peptidase I
  ENST ID: ENST00000597663
  CDS Start-End: 1-331
cttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcaggaaaaaacccttccctgccaaaggtgactgtgttttctgccgccgaaggagggcccggtccctccaggctcagtgtggcttctccctgacccccgccctagaacttttgccagtgccttttctgaaactcctgtgtcccgggccccccaggcggagaaggatatgccggattctgcctggggctgggctctaggagaccccaaatttgacaccacagaaagcaaa

SEQ ID NO: 172690 - DNA, 769 bp, Homo sapiens
  Payload ID: 13950
  Gene Symbol: PGPEP1
  Gene Name: pyroglutamyl-peptidase I
  ENST ID: ENST00000604499
  CDS Start-End: 85-600
ctcgcgcggccgagaggctgcagcggcagcagctgtcgcgccagtcgcaacagaagcaggtccgaggcacagcccgatcccgccatggagcagccgaggaaggcggtggtagtgacgggatttggcccttttggggaacacaccgtgaacgccagttggattgcagttcaggagctagaaaagctaggccttggcgacagcgtggacctgcatgtgtacgagattccggttgagtaccaaacagtccagagactcatccccgccctgtgggagaagcacagtccacagctggtggtgcatgtgggggtgtcaggcatggcgaccacagtcacactggagaaatgtggacacaacaagggctacaaggggctggacaactgccgcttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcagagtcacggtcgatcagccttcgtccacgtgcccccactggggaagccgtacaacgcggaccagctgggcagggcactgagagccatcattgaggagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttca

SEQ ID NO: 172691 - DNA, 545 bp, Homo sapiens
  Payload ID: 13950
  Gene Symbol: PGPEP1
  Gene Name: pyroglutamyl-peptidase I
  ENST ID: ENST00000597431
  CDS Start-End: 44-379
cagtcgcaacagaagcaggtccgaggcacagcccgatcccgccatggagcagccgaggaaggcggtggtagtgacgggatttggcccttttggggaacacaccgtgaacgccagttggattgcagttcaggagctagaaaagctaggccttggcgacagcgtggacctgcatgtgtacgagattccggttgagtaccaaacagtccagagactcatccccgccctgtgggagaagcacagtccacagatatctctgcgactttacctactacacctctttgtaccagagtcacggtcgatcagccttcgtccacgtgcccccactggggaagccgtacaacgcggaccagctgggcagggcactgagagccatcattgaggagatgttggacctcctggagcagtcagagggcaaaatcaactattgccacaaacactgagggacgctcaggtctcctaagacctcatcctgctggggaccccacgaggggacatccaccctctggggtgtggccaggaaaagacaagctcttcagcttggggat

SEQ ID NO: 172692 - DNA, 762 bp, Homo sapiens
  Payload ID: 13950
  Gene Symbol: PGPEP1
  Gene Name: pyroglutamyl-peptidase I
  ENST ID: ENST00000595066
  CDS Start-End: 84-524
tcgcgcggccgagaggctgcagcggcagcagctgtcgcgccagtcgcaacagaagcaggtccgaggcacagcccgatcccgccatggagcagccgaggaaggcggtggtagtgacgggatttggcccttttggggaacacaccgtgaacgccagttggattgcagttcaggagctagaaaagctaggccttggcgacagcgtggacctgcatgtgtacgagattccggttgagtaccaaacagtccagagactcatccccgccctgtgggagaagcacagtccacagctggtggtgcatgtgggggtgtcaggcatggcgaccacagtcacactggagaaatgtggacacaacaagggctacaaggggctggacaactgccgcttttgccccggctcccagtgctgcgtggaggacgggcctgaaagcattgactccatcatcgacatggatgctgtgtgcaagcgagtcaccacgttgggcctggatgtgtcggtgaccatctcgcaggatgccggcaggtagggccctgtggggtgggagtgagtggggatttccctcctccacccactgagcctggtgtagaacaagccaagcgtgttgaccttggcctctttggaccaagcactcagtgtatactaggcacagagccaagtatttgtacgtagcaggtgccgttggttctgctcctgggactcatggatctgcccacttctccccaccatcacggtccccaccaaggcccccagcatctcccacctgg

SEQ ID NO: 172693 - DNA, 995 bp, Homo sapiens
  Payload ID: 13951
  Gene Symbol: PGPEP1L
  Gene Name: pyroglutamyl-peptidase I-like
  Uniprot ID: A6NFU8
  ENST ID: ENST00000378919
  CDS Start-End: 207-797
ccaggcagagaaggtgcccggagctcagagcgcgcagagcccggccgctgggccgctgcctgagccagggaggcgcagcgcgagctcccacttcgtcttcatggattcccagcccagctgcgtggtggtgactgcatgttttcaaggttgagccacgtggtagtgtgtccagaattggtgggttgttggtctcactgacttcaagaatgaagccgcggactctcgtggagctctccaagctgggcctggggaatgaaacagtggtgcagctgcggactctggagctgcctgtagattacagggaggctaagcggagggtcaccggaatctgggaagatcatcagccgcaactcgtcgtgcatgtgggcatggacaccgccgccaaggcgatcattctggaacagtctggcaagaaccaaggctaccgggacgccgacatccgcagcttctggcccgagggcggcgtgtgcctacctggcagcccagacgtgctggagtcaggggtctgcatgaaggcagtctgcaagcgcgtagctgtggagggtgtcgacgtgatcttttcccgagatgcaggcagatacgtctgtgattatacctattacctgtctctgcatcatggaaagggctgcgcggcactcatccatgtccctccactatcgcgcgggctcccggccagcctgctgggaagagccttgagagtcatcatccaggaaatgctggaagaggtgggaaagcccaagcacagagcccagttcgaagaaaactcaaccatggtccttccagccaaagggaactgaccgggggattgctcctctagagaaaattgaatgtttcaatcctgtatgtagcactcaactgtgcattgagaaactttttcaaaaattgcttgtaagacaaagagggtggaaaactctgaattagcccaacaaaatcacaaagggttattttattgtcaggagaaagaacactctgaaaggtggacatttcacagggga

SEQ ID NO: 172694 - DNA, 1483 bp, Homo sapiens
  Payload ID: 13951
  Gene Symbol: PGPEP1L
  Gene Name: pyroglutamyl-peptidase I-like
  Uniprot ID: A6NFU8
  ENST ID: ENST00000535714
  CDS Start-End: 807-1235
agtagcaacttgctggagtcgccttctgtgctgtggaagttttgttgttttgcttgtttgcaataaccgttgctgctgcttactgtttgggtccgcactgcctttatgagctgtaacgctcaccgtgaaggtctgcagcttcgttcttaaagccagccacatcacggacccaccgggagaaacgaataactccaaacacgccaccttaagagccgtagcactcatgatgaaggtccgtagcttcactcctgaagtcagcgagatcacgaatctgccagaaggaagaaactccgaacacatgcgagcatcagaagaaacaaacttgggacacgctgcctttaaaaactgtaacactcaccgccagggtccgcggcttcgttcttgaagtcagtgagaccaagaatccgccgattctggacacaccatgacggaactagatccttggcctttcggggcccagaacgctacggacgccgggcggccaggaggggttgggctcccgctccaccccggtccccggcgagcacgcggccaggcagagaaggtgcccggagctcagagcgcgcagagcccggccgctgggccgctgcctgagccagggaggcgcagcgcgagctcccacttcgtcttcatggattcccagcccagctgcgtggtggtgactggagctctccaagctgggcctggggaatgaaacagtggtgcagctgcggactctggagctgcctgtagattacagggaggctaagcggagggtcaccggaatctgggaagatcatcagccgcaactcgtcgtgcatgtgggcatggacaccgccgccaaggcgatcattctggaacagtctggcaagaaccaaggctaccgggacgccgacatccgcagcttctggcccgagggcggcgtgtgcctacctggcagcccagacgtgctggagtcaggggtctgcatgaaggcagtctgcaagcgcgtagctgtggagggtgtcgacgtgatcttttcccgagatgcaggcagatacgtctgtgattatacctattacctgtctctgcatcatggaaagggctgcgcggcactcatccatgtccctccactatcgcgcgggctcccggccagcctgctgggaagagccttgagagtcatcatccaggaaatgctggaagaggtgggaaagcccaagcacagagcccagttcgaagaaaactcaaccatggtccttccagccaaagggaactgaccgggggattgctcctctagagaaaattgaatgtttcaatcctgtatgtagcactcaactgtgcattgagaaactttttcaaaaattgcttgtaagacaaagagggtggaaaactctgaattagcccaacaaaatcacaaagggttattttattgtcaggagaaagaacactctgaaaggtggacatttcacaggggatgaactagcttcagttatggttttcatgacaataaaatgaaatccgagtc

SEQ ID NO: 172695 - DNA, 787 bp, Homo sapiens
  Payload ID: 13952
  Gene Symbol: PPA1
  Gene Name: pyrophosphatase (inorganic) 1
  ENST ID: ENST00000373230
  CDS Start-End: 11-547
ctccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgtatgtaatagtgttgtgatcctctgacatagcctctgcctctggaccagggatagtacctcaagcctgtaatcccagtgctttgggaagccaaggcaggaggattgcttgagcccaggagtttgagaccagcctgggcaacatgacgagaccccatttctacaaaaaatttaaaaattagctgggcgtgtgcatgcttatagtcccagctactcaggaggctgagatatcaatgatgtcaaacggctgaaacctggctacttagaa

SEQ ID NO: 172696 - DNA, 1295 bp, Homo sapiens
  Payload ID: 13952
  Gene Symbol: PPA1
  Gene Name: pyrophosphatase (inorganic) 1
  Uniprot ID: Q15181
  ENST ID: ENST00000373232
  CDS Start-End: 101-970
agtgctcgcagtgcgcaggcgtggggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaacttgg

SEQ ID NO: 172697 - DNA, 644 bp, Homo sapiens
  Payload ID: 13952
  Gene Symbol: PPA1
  Gene Name: pyrophosphatase (inorganic) 1
  ENST ID: ENST00000625364
  CDS Start-End: 108-644
ccggtccagtgctcgcagtgcgcaggcgtggggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgtatgtaatagtgttgtgatcctctga

SEQ ID NO: 172698 - DNA, 1072 bp, Homo sapiens
  Payload ID: 13953
  Gene Symbol: PPA2
  Gene Name: pyrophosphatase (inorganic) 2
  ENST ID: ENST00000351450
  CDS Start-End: 18-185
ggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 172699 - DNA, 1414 bp, Homo sapiens
  Payload ID: 13953
  Gene Symbol: PPA2
  Gene Name: pyrophosphatase (inorganic) 2
  Uniprot ID: Q9H2U2
  ENST ID: ENST00000348706
  CDS Start-End: 15-932
ccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaattactctcctttggacatttattgatataaaaagaagattttggccaggcacggtggctcatgcctgtaatttcagcactttgggaggccgaggtgggcagatcacaaggtcaggagttcaagaccagcctggccagtatgttgaaaccccatctctattaaaaatacaaaaattagccaggcgtggtggtgcatgcctgtagacccagctactcaggaggctgaggcagaagaactgcttgagcccaggaggcagaggttgcagtgagcagagattgtgccactgcactccagcctaggcgacagagagagactccgtctc

SEQ ID NO: 172700 - DNA, 667 bp, Homo sapiens
  Payload ID: 13953
  Gene Symbol: PPA2
  Gene Name: pyrophosphatase (inorganic) 2
  Uniprot ID: Q9H2U2
  ENST ID: ENST00000354147
  CDS Start-End: 1-507
atgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 172701 - DNA, 1684 bp, Homo sapiens
  Payload ID: 13953
  Gene Symbol: PPA2
  Gene Name: pyrophosphatase (inorganic) 2
  Uniprot ID: Q9H2U2
  ENST ID: ENST00000341695
  CDS Start-End: 32-1036
ccgcgcgcacagcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaattactctcctttggacatttattgatataaaaagaagattttggccaggcacggtggctcatgcctgtaatttcagcactttgggaggccgaggtgggcagatcacaaggtcaggagttcaagaccagcctggccagtatgttgaaaccccatctctattaaaaatacaaaaattagccaggcgtggtggtgcatgcctgtagacccagctactcaggaggctgaggcagaagaactgcttgagcccaggaggcagaggttgcagtgagcagagattgtgccactgcactccagcctaggcgacagagagagactccgtctcaaaaaaaaaaaaaagattttgtttcatttcatagcacaaatttagaggcattgagttgaccatttctagtttctatacctgaaggaacccattgattttaccagtttttatttctgtagattggatgtaaaaatcacagattcaataaattaataaactttgtgta

SEQ ID NO: 172702 - DNA, 859 bp, Homo sapiens
  Payload ID: 13953
  Gene Symbol: PPA2
  Gene Name: pyrophosphatase (inorganic) 2
  Uniprot ID: Q9H2U2
  ENST ID: ENST00000432483
  CDS Start-End: 1-699
atgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 172703 - DNA, 596 bp, Homo sapiens
  Payload ID: 13953
  Gene Symbol: PPA2
  Gene Name: pyrophosphatase (inorganic) 2
  ENST ID: ENST00000504028
  CDS Start-End: 10-596
attgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacaga

SEQ ID NO: 172704 - DNA, 839 bp, Homo sapiens
  Payload ID: 13953
  Gene Symbol: PPA2
  Gene Name: pyrophosphatase (inorganic) 2
  ENST ID: ENST00000506815
  CDS Start-End: 1-129
accagtgcagggaccgggtcgcgccgtgctatggccctgtaccacactgaggagcgcggccagccctgctcgcagaattaccgcctcttctttagaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatggtctcagaaatattccagtatatacaataaatcgcatagtcatcctgccttcacttgacaggagccaaacttccagcctgtcctacctgcctgcacatcaggattcctgtgtgcccctggatgcagccctacatgttgttttgtatttttgttccctcttgggtctacaaagttacttatcttgtttttgagtctttttgatgttaatctgtttataaggtatctattttaggtaggttagcctgagggagtacattgaaacacgaatttagtgcccctcctgtcaaaaggtctctgttttttccgaagcag

SEQ ID NO: 172705 - DNA, 571 bp, Homo sapiens
  Payload ID: 13953
  Gene Symbol: PPA2
  Gene Name: pyrophosphatase (inorganic) 2
  ENST ID: ENST00000513649
  CDS Start-End: 10-351
attgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggaggttttaaagatagcaatgtgaatatacatgatagaaaactaactttgaggccgagtgcagtggctaacacctgtaatcccagcccattgagaaaccaagattgccaccaaggagccaatgaatcccattaaacaatatgtaaaggatggaaagctacgctatgtggcgaatatcttcccttacaagggttatatatggaattatggtaccctccctcagacttgggaagatccccatgaaa

SEQ ID NO: 172706 - DNA, 582 bp, Homo sapiens
  Payload ID: 13953
  Gene Symbol: PPA2
  Gene Name: pyrophosphatase (inorganic) 2
  ENST ID: ENST00000510015
  CDS Start-End: 10-582
attgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgct

SEQ ID NO: 172707 - DNA, 1177 bp, Homo sapiens
  Payload ID: 13953
  Gene Symbol: PPA2
  Gene Name: pyrophosphatase (inorganic) 2
  ENST ID: ENST00000509031
  CDS Start-End: 58-249
ccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggacactgaggctcaaggcatttttatagacttgtctaagatctggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaaccagaaaaccagtttgcttttaatggagaattcaaaaacaaggcttttgctcttgaagttattaaatccactcatcaatgttggaaagcattgcttatgaagaagtgtaatggaggagctataaattgcacaaacgtgcagatatctgatagccctttccgttgcactcaagaggaagcaagatcattagttgaatcggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaattac

SEQ ID NO: 172708 - DNA, 677 bp, Homo sapiens
  Payload ID: 13953
  Gene Symbol: PPA2
  Gene Name: pyrophosphatase (inorganic) 2
  ENST ID: ENST00000508518
  CDS Start-End: 1-677
tgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattcctatgaagaaagcacgaaatgatgaatatgagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcctattgatgtttgcgaaataggctcaaagattctttcttgtggagaagttattcatgtgaagatccttggaattttggctcttattgatgaaggtgaaacagattggaaattaattgctatcaatgcgaatgatcctgaagcctcaaagtttcatgatattgatgatgttaagaagttcaaaccgggttacctggaagctactcttaattggtttagattatataaggtaccagatggaaaa

SEQ ID NO: 172709 - DNA, 481 bp, Homo sapiens
  Payload ID: 13953
  Gene Symbol: PPA2
  Gene Name: pyrophosphatase (inorganic) 2
  ENST ID: ENST00000514209
  CDS Start-End: 10-177
attgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagattctttcttgtggagaagttattcatgtgaagatccttggaattttggctcttattgatgaaggtgaaacagattggaaattaattgctatcaatgcgaatgatcctgaagcctcaaagtttcatgatattgatgatgtt

SEQ ID NO: 172710 - DNA, 714 bp, Homo sapiens
  Payload ID: 13953
  Gene Symbol: PPA2
  Gene Name: pyrophosphatase (inorganic) 2
  ENST ID: ENST00000502596
  CDS Start-End: 451-714
agcgaggaggcggcggatcaagaccccaaagcggagagcagaggcgcagggctgccggctggggggtagatagcgccctgtgccctgccagccgccctccccgaggggtaggcagagtgcaagcggccaccccgcggcggcctgcagccattagccggcccggccgccgttcccggttcacacaactcagtgaggaagggaaggcagagcccgcccacacgccggccttcctagaggcgtaagaaacctcctactgcgggagctccctgacgtcggagaggcaggcggaactttgcggatgcctaatccagcgcgtcttctttttttggagggactctgatgaaggttctttccccagaagcttgacttgagaatgtaactggtcactacatttccccctttcatgatattcctctgaaggtgaactctaaagaggaaaatggcattcctatgaagaaagcacgaaatgatgaatatgagaatctgtttaatatgattgtagaaatacctcggtggacaaatgctaaaatggagattgccaccaaggagccaatgaatcccattaaacaatatgtaaaggatggaaagctacgctatgtggcgaatatcttcccttacaagggttatatatggaattatggtaccctccctcagacttgggaagatccccatgaaaaagataagagcacgaactgctttggagataatgatcct

SEQ ID NO: 172711 - DNA, 368 bp, Homo sapiens
  Payload ID: 13953
  Gene Symbol: PPA2
  Gene Name: pyrophosphatase (inorganic) 2
  ENST ID: ENST00000515567
  CDS Start-End: 1-208
gtggacaaatgctaaaatggagattgccaccaaggagccaatgaatcccattaaacaatatgtaaaggatggaaagctacgctatgtggcgaatatcttcccttacaagggttatatatggaattatggtaccctccctcaggtatcatcttcaccaaataaagaaagtaatgaagaagagcaagtgtggcacttccttggcaagtgattgaaacatctgaaattctgctgtcaagattcccatctctaaggactccaagtgctagagacaagggggtctatgagcatttactgacttcctgttaaaacttcattttttcaaactttttgagctatgcaatatataaataaacagtaagaattttaaa

SEQ ID NO: 172712 - DNA, 1855 bp, Homo sapiens
  Payload ID: 13954
  Gene Symbol: PYCR1
  Gene Name: pyrroline-5-carboxylate reductase 1
  Uniprot ID: P32322
  ENST ID: ENST00000329875
  CDS Start-End: 66-1025
gccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcaccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaatgcaaaa

SEQ ID NO: 172713 - DNA, 1890 bp, Homo sapiens
  Payload ID: 13954
  Gene Symbol: PYCR1
  Gene Name: pyrroline-5-carboxylate reductase 1
  Uniprot ID: P32322
  ENST ID: ENST00000337943
  CDS Start-End: 444-1394
gtacgacccgcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaagttagaccagctgggaccaggggaggtgggcacccggctgcgggaggagcggccaggctggcactgcccccctaacttgctctcgatcctgccggtctcgtcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaatgcaaaa

SEQ ID NO: 172714 - DNA, 1346 bp, Homo sapiens
  Payload ID: 13954
  Gene Symbol: PYCR1
  Gene Name: pyrroline-5-carboxylate reductase 1
  Uniprot ID: P32322
  ENST ID: ENST00000402252
  CDS Start-End: 27-1067
agctgggttggggtcgggctccgggaatggtgggcggcggtcgccgggtggggcgcgacgagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcaccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagccc

SEQ ID NO: 172715 - DNA, 1811 bp, Homo sapiens
  Payload ID: 13954
  Gene Symbol: PYCR1
  Gene Name: pyrroline-5-carboxylate reductase 1
  ENST ID: ENST00000403172
  CDS Start-End: 115-981
ggattcgctggcgcgacgggggcggggcctgggtgcgggtgccgcgtggcggccgcagcgctgagggagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcaccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaatgcaaaa

SEQ ID NO: 172716 - DNA, 841 bp, Homo sapiens
  Payload ID: 13954
  Gene Symbol: PYCR1
  Gene Name: pyrroline-5-carboxylate reductase 1
  ENST ID: ENST00000405481
  CDS Start-End: 83-841
gtgcgggtgccgcgtggcggccgcagcgctgagggagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctg

SEQ ID NO: 172717 - DNA, 681 bp, Homo sapiens
  Payload ID: 13954
  Gene Symbol: PYCR1
  Gene Name: pyrroline-5-carboxylate reductase 1
  ENST ID: ENST00000579366
  CDS Start-End: 354-681
gggcctgggctgcccctttgaccggctggtggtggtgtacaccttcctggctgtgctcctgtacctcagcgccgccgtgatctggccagtcttctgtttcgatcccaagtacggtgagcccaaacggccccccaactgtgctcggggcagctgtccctgggacagccagctggtggtggccatcttcacctacgtcaacctgctcctgtacgtcgttgacctcgcctactcccagaggattcgcttcgtgcccagcctgtagcccacagtggcagcccacccacctctgctctctggccaccagctccaggctctgcgagggaaactcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgc

SEQ ID NO: 172718 - DNA, 578 bp, Homo sapiens
  Payload ID: 13954
  Gene Symbol: PYCR1
  Gene Name: pyrroline-5-carboxylate reductase 1
  ENST ID: ENST00000585244
  CDS Start-End: 327-578
gcgcacggtagctgggttggggtcgggctccgggaatggtgggcggcggtcgccgggtggggcgcgacggtagcccagttctgggcggggtgggaacccagacgggggacccctaggcgccgggccctccctctccccgtacttttcccccttcccagtcatttcttctgcggaacctccacccctccagtgggtgcgggaccctaggcagcaggccaggcaccgccgctctgactgggggccccgaagcagttaacgggccggacagcaaagtggaaaagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgcc

SEQ ID NO: 172719 - DNA, 377 bp, Homo sapiens
  Payload ID: 13954
  Gene Symbol: PYCR1
  Gene Name: pyrroline-5-carboxylate reductase 1
  ENST ID: ENST00000583564
  CDS Start-End: 95-377
agctgggttggggtcgggctccgggaatggtgggcggcggtcgccggagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcct

SEQ ID NO: 172720 - DNA, 868 bp, Homo sapiens
  Payload ID: 13954
  Gene Symbol: PYCR1
  Gene Name: pyrroline-5-carboxylate reductase 1
  ENST ID: ENST00000582198
  CDS Start-End: 141-868
ggccacggtctccatgctctgctcctctggccgcagcagaaccctgtgaaccccaggcaatgacagcaggatcctgaagcccatgcaggctctgaaccacgcggccatccagaaggggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctga

SEQ ID NO: 172721 - DNA, 949 bp, Homo sapiens
  Payload ID: 13954
  Gene Symbol: PYCR1
  Gene Name: pyrroline-5-carboxylate reductase 1
  ENST ID: ENST00000584848
  CDS Start-End: 1-522
gccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacggagctgcagtccatggctgaccaggagcaggtgtcaccagccgccatcaagaagaccatcctggacaaggtgaagctggactcccctgcagggaccgctctgtcaccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggaggg

SEQ ID NO: 172722 - DNA, 767 bp, Homo sapiens
  Payload ID: 13954
  Gene Symbol: PYCR1
  Gene Name: pyrroline-5-carboxylate reductase 1
  ENST ID: ENST00000585215
  CDS Start-End: 91-767
ctgggtgcgggtgccgcgtggcggccgcagcgctgaggggtggagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggcca

SEQ ID NO: 172723 - DNA, 1144 bp, Homo sapiens
  Payload ID: 13954
  Gene Symbol: PYCR1
  Gene Name: pyrroline-5-carboxylate reductase 1
  ENST ID: ENST00000577756
  CDS Start-End: 56-709
tcccgcagagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggagctgcagtccatggctgaccaggagcaggtgtcaccagccgccatcaagaagaccatcctggacaaggtgaagctggactcccctgcagggaccgctctgtcaccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacc

SEQ ID NO: 172724 - DNA, 572 bp, Homo sapiens
  Payload ID: 13954
  Gene Symbol: PYCR1
  Gene Name: pyrroline-5-carboxylate reductase 1
  ENST ID: ENST00000579698
  CDS Start-End: 78-572
gtacgacccgcgcacggtagctgggttgggagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggac

SEQ ID NO: 172725 - DNA, 510 bp, Homo sapiens
  Payload ID: 13954
  Gene Symbol: PYCR1
  Gene Name: pyrroline-5-carboxylate reductase 1
  ENST ID: ENST00000577624
  CDS Start-End: 114-510
gattcgctggcgcgacgggggcggggcctgggtgcgggtgccgcgtggcggccgcagcgctgagggagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtga

SEQ ID NO: 172726 - DNA, 528 bp, Homo sapiens
  Payload ID: 13954
  Gene Symbol: PYCR1
  Gene Name: pyrroline-5-carboxylate reductase 1
  ENST ID: ENST00000581271
  CDS Start-End: 183-528
agagccggccgcgcgcccagggacgccagctggacgcgtccgtgtccgggtggcccaagacaaagccctgcgtggagggcccctcacaggccccaatcgggccgccccctccgcccgcgtcctcggaccccacgtagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagccccca

SEQ ID NO: 172727 - DNA, 1904 bp, Homo sapiens
  Payload ID: 13954
  Gene Symbol: PYCR1
  Gene Name: pyrroline-5-carboxylate reductase 1
  Uniprot ID: P32322
  ENST ID: ENST00000619204
  CDS Start-End: 115-1074
ggattcgctggcgcgacgggggcggggcctgggtgcgggtgccgcgtggcggccgcagcgctgagggagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggggctgccaagatgctgctgcactcagaacagcacccaggccagctcaaggacaacgtcagctctcctggtggggccaccatccatgccttgcatgtgctggagagtgggggcttccgctccctgctcatcaacgctgtggaggcctcctgcatccgcacacgggagctgcagtccatggctgaccaggagcaggtgtcaccagccgccatcaagaagaccatcctggacaaggtgaagctggactcccctgcagggaccgctctgtcaccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaatgcaaaa

SEQ ID NO: 172728 - DNA, 1740 bp, Homo sapiens
  Payload ID: 13954
  Gene Symbol: PYCR1
  Gene Name: pyrroline-5-carboxylate reductase 1
  ENST ID: ENST00000629768
  CDS Start-End: 115-768
ggattcgctggcgcgacgggggcggggcctgggtgcgggtgccgcgtggcggccgcagcgctgagggagccggtgccatctgtgggggctttgggccaggggtctccggacagcatgagcgtgggcttcatcggcgctggccagctggcttttgccctggccaagggcttcacagcagcaggcgtcttggctgcccacaagataatggctagctccccagacatggacctggccacagtttctgctctcaggaagatgggggtgaagttgacaccccacaacaaggagacggtgcagcacagtgatgtgctcttcctggctgtgaagccacacatcatccccttcatcctggatgaaataggcgccgacattgaggacagacacattgtggtgtcctgcgcggccggcgtcaccatcagctccattgagaagaagctgtcagcgtttcggccagcccccagggtcatccgctgcatgaccaacactccagtcgtggtgcgggagggggccaccgtgtatgccacaggcacgcacgcccaggtggaggacgggaggctcatggagcagctgctgagcagcgtgggcttctgcacggaggtggaagaggacctgattgatgccgtcacggggctcagtggcagcggccccgcctacgcattcacagccctggatgccctggctgatgggggtgtgaagatgggacttccaaggcgcctggcagtccgcctcggggcccaggccctcctgggagctgcagtccatggctgaccaggagcaggtgtcaccagccgccatcaagaagaccatcctggacaaggtgaagctggactcccctgcagggaccgctctgtcaccttctggccacaccaagctgctcccccgcagcctggccccagcgggcaaggattgacacgtcctgcctgaccaccatcctgccaccaccttctcttctcttgtcactagggggactagggggtccccaaagtggcccactttctgtggctctgatcagcgcaggggccagccagggacatagccagggaggggccacatcacttcccactggaaatctctgtggtctgcaagtgcttcccagcccagaacaggggtggattccccaacctcaacctcctttcttctctgctcccaaaccatgtcaggaccaccttcctctagagctcgggagcccggagggtcttcacccactcctactccagtatcagctggcacgggctccttcctgagagcaaaggtcaaggaccccctctgtgaaggctcagcagaggtgggatcccacgccccctcccggcccctccctgccctccattcagggagaaacctctccttcccgtgtgagaagggccagagggtccaggcatcccaagtccagcgtgaagggccacagcccctcttggctgccaagcacgcagatcccatggacatttggggaaagggctccttgggctgctggtgaacttctgtggccaccacctcctgctcctgacctccctgggagggtgctatcagttctgtcctggccctttcagttttataagttggtttccagcccccagtgtcctgacttctgtctgccacatgaggagggaggccctgcctgtgtgggagggtggttactgtgggtggaatagtggaggccttcaactgattagacaaggcccgcccacatcttggagggcatctgccttactgattaaaatgtcaatgtaatctaatgcaaaa

SEQ ID NO: 172729 - DNA, 1689 bp, Homo sapiens
  Payload ID: 13955
  Gene Symbol: PYCR2
  Gene Name: pyrroline-5-carboxylate reductase family, member 2
  Uniprot ID: Q96C36
  ENST ID: ENST00000343818
  CDS Start-End: 150-1112
ggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatc

SEQ ID NO: 172730 - DNA, 1549 bp, Homo sapiens
  Payload ID: 13955
  Gene Symbol: PYCR2
  Gene Name: pyrroline-5-carboxylate reductase family, member 2
  ENST ID: ENST00000612039
  CDS Start-End: 231-971
gattggtcgcccggacggggcggggccacgtggcctaaggcgccatcagccgcccgggagatatccgccgggggagaatagggttgcaccatcccagaagctgctgttagctcgccggtcctcggcacgccgcccgttcgcccctgcgctgtccgcccttcccctagcgttacttccggtccctcgctgagggggttcgtgcggctcccaggaggcgtgaaccgcggaccatgagcgtgggcttcatcggggccggccagctggcctatgctctggcgcggggcttcacggccgcaggcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaaggcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatct

SEQ ID NO: 172731 - DNA, 422 bp, Homo sapiens
  Payload ID: 13955
  Gene Symbol: PYCR2
  Gene Name: pyrroline-5-carboxylate reductase family, member 2
  ENST ID: ENST00000472798
  CDS Start-End: 162-422
agagggttgagggggagagggagactggcactgttaggacggctctgggttttagagccagggaaagcgtggtaacgggctgggccgcgacccctagttgaaaagctctgtcttctgcaggcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaac

SEQ ID NO: 172732 - DNA, 597 bp, Homo sapiens
  Payload ID: 13955
  Gene Symbol: PYCR2
  Gene Name: pyrroline-5-carboxylate reductase family, member 2
  ENST ID: ENST00000489681
  CDS Start-End: 125-597
gggggcctccgtcccaccagcatgagcgaatgaaaggggagtttgcgtccggtggggtagatgagactctggttgagcagcaagcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagccacatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaa

SEQ ID NO: 172733 - DNA, 1538 bp, Homo sapiens
  Payload ID: 13955
  Gene Symbol: PYCR2
  Gene Name: pyrroline-5-carboxylate reductase family, member 2
  ENST ID: ENST00000612651
  CDS Start-End: 1-960
atgagcgtgggcttcatcggggccggccagctggccatgctctggcgcggggcttcacggccgcagcatcctgtcggctcacaagataatagccagctccccagaaatgaacctgcccacggtgtccgcgctcaggaagatgggtgtgaacctgacacgcagcaacaaggagacggtgaagcacagcgacgtcctgtttctggctgtgaagcccatatcatccccttcatcctggatgagattggggccgacgtgcaagccagacacatcgtggtctcctgtgcggctggtgtcaccatcagctctgtggagaagaagctgatggcattccagccagcccccaaagtgattcgctgcatgaccaacacacctgtggtagtgcaggaaggcgctacagtgtacgccacgggcacccatgccctggtggaggatgggcagctcctggagcagctcatgagcagcgtgggcttctgcactgaggtggaagaggacctcatcgatgccgtcacggggctcagtggcagcgggcctgcctatgcattcatggctctggacgcattggctgatggtggggtgaagatgggtttgccacggcgcctggcaatccaactcggggcccaggctttgctgggagctgccaagatgctgctggactcggagcagcatccatgccagcttaaggacaatgtctgctcccctgggggagccaccatccacgccctgcactttctagagagtgggggcttccgctctctgctcatcaatgcagttgaggcctcctgtatccgaacacgagagctacagtccatggccgaccaagaaaagatctccccagctgcccttaagaagaccctcttagacagagtgaagctggaatcccccacagtctccacactgaccccctccagcccagggaagctcctcacaagaagcctggccctgggaggcaagaaggactaaggcagcatctgtcccctctgtgattcagagcccttagttgagagcccctgccgcccctgccacccccctgccccgctcccaccattgcccctcctcagctgtgcaaggagaaagcatgcttaggaagttttcaggtccttgtgataaaacctccttaaatctgttcagaccaagcaatgcgagcttcctctcctgtcccatgttggaagttgctctgaaggggtggtagatgctggaagccagacacaaccctgcgtacgctgctcagttggtggagactggggctgggactggagtcagcccagctgggaggaggggctggggaggatctgcagctgaagcccgaggcagggttggtgtgatgccaaggcaaagtggtgaggagaaaacaggaaacgggctttctctgaattggtaaatgggaaagaagtgagcaacttaagattgtcacaattaatcacaagtgtacaggattagactgggtttatatttaactcttgcttcataggtgtaccatttaaagagtgttatttaatgctaagtttaactgctttaataaagtttatttttaaatatct

SEQ ID NO: 172734 - DNA, 2678 bp, Homo sapiens
  Payload ID: 13956
  Gene Symbol: PYCRL
  Gene Name: pyrroline-5-carboxylate reductase-like
  ENST ID: ENST00000220966
  CDS Start-End: 31-891
ctagatctgtgggcggggcgcggcctgtggatgggcggtgagcgcagcggcgtccgaggcaacaagatggcagctgcggagccgtctccgcggcgcgtgggcttcgtgggcgcgggccgcatggcgggggccatcgcgcagggcctcatcagagcaggaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggagctgctgcccccaaacacacgggtgctgcgggtcttgcccaacctgccctgtgtggtccaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtcaagatgggcatgcccagcagcctggcccaccgcatcgctgcccagaccctgctggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtaggctgggctctggccatcctttcctgcctctgtgcccctgcctctccctgtgtcccttcccctgaggactgcggctccctccctcctgcatgagggtctcctactgctccttctccccttgcacagggaaatgcagggggcaggacttgggaggttccagcaggcgggggagccccgaccagtggggacactcctccctccccagtgagcagaaggcaccgtggtggtggctctgccccttgctgcagtgagcccaccttgctgcaacattggttctgaggggcccaagagatggcgtcttggtcatttgcccgcatggttgggcagttggttgaggccatgaacagaacttacggtaacaggcacggctggcccaatgcctggtctggagctggagcttgcctttggctttccaggtggctccgtgcagctacagccaggccggctgcctcatctcagctctagggggcacgagccatatggggtctgcacaagagaccctctcccctgcagtaaagccaggggccctggcctgatggggcccccatggggagctggagcctgccctgcagcctggagaagagggtggctgtggtgggcgtgctcatcccctgctaaggagcaggagctgctgggccaggtctgcggcagtgctggggtggcaccaggtgggcagtggtaggtggggtggcttgaggtctgggagggtggccctggccagccaggacacatgcagacccctggctttagtctggatacaggctccctctttcctcccaatcctaagctcctgacaagtggccaggtggctctgggccctcctgccccgtgcctaggtcaggggtcctggaataccccgtagctctggcaccaccacactggcctctgatggcaagacttggcccctccacctgtccctaacggacggcaggtcaggaaagccaggactcaggggagaagcaaacccccaggattgaaggctagggttctagggcctttgggtggggagggcccgggccggacagcctcagctccgtcccctgccccacaagattcacctgggcctccagtcccacgctggccccaactgctgcagctctcggcttccgcccaacagcctctggaggtgaggcgggagcatgccctcagcgaggctgggcggcgggtcctgctgtgccatctccctgtgcgcctgagcagatcaatccaccagtgcaaaacagggctaacggcacctgcaggacagcagcacgctccatccctcatgctcagctgcctctgcggccacggacttctgcccttcatctgctctctcttactctcctgagcctagcccgtccgtaagctccctcccctgcctggttcccagggcaggctgactcagttgactgcttggtccaagcctggccctggcacttgtcagggtcagcctaaggagatgggaataaagaggccagagagcaccaagtgagctcatgtttcaccagaggtggataaaaccaagttctgggctgggcccagtggctcacatctgtaattccagcactttgggaggccgaggcgggcagatcacaaagtcaggagtttgagaccaacctgaccaacatggagaaaccccatctctactaaaaatacaaaattagctggatgtggtggtgcgtgcctgtaatcccagctacttgggaggctgaggcaggagaattgcttgaatccaggaggcggagattgcagagagccaagatcatgccactgcactccagcctgggtgacagcaagactctgtcttgg

SEQ ID NO: 172735 - DNA, 985 bp, Homo sapiens
  Payload ID: 13956
  Gene Symbol: PYCRL
  Gene Name: pyrroline-5-carboxylate reductase-like
  ENST ID: ENST00000377579
  CDS Start-End: 419-832
atagccctttcgggccaataagcagcgagaggcggggttcccgcgccttgcgaacttgtagagtgcggacaaaaagccggccggagtgtgccgtcccagaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggagctgctgcccccaaacacacgggtgctgcgggtcttgcccaacctgccctgtgtggtccaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtcaagatgggcatgcccagcagcctggcccaccgcatcgctgcccagaccctgctggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtaggctgggctctggccatcctttcctgcctctgtgcccctgcctctccctgtgtcccttcccctgaggactgcggctccctccctcctgcatgagggtctcctactgctccttctccccttgcacagggaaatgcagggggcaggacttgggagg

SEQ ID NO: 172736 - DNA, 1324 bp, Homo sapiens
  Payload ID: 13956
  Gene Symbol: PYCRL
  Gene Name: pyrroline-5-carboxylate reductase-like
  ENST ID: ENST00000447926
  CDS Start-End: 22-156
agcggcgtccgaggcaacaagatggcagctgcggagccgtctccgcggcgcgtgggcttcgtgggcgcgggccgcatggcgggggccatcgcgcagggcctcatcagagcagccatacttcagggtccagaagagtcaagatcaatcgggaaatagcttactatgagtctcaggagtcttccctgtgaaacctggcagtaccgcatgcctcccagagctgtacaggaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggagctgctgcccccaaacacacgggtgctgcgggtcttgcccaacctgccctgtgtggtccaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtcaagatgggcatgcccagcagcctggcccaccgcatcgctgcccagaccctgctggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtaggctgggctctggccatcctttcctgcctctgtgcccctgcctctccctgtgtcccttcccctgaggactgcggctccctccctcctgcatgagggtctcctactgctccttctccccttgcacagggaaatgcagggggcaggacttgggaggttccagcaggcgggggagccccgaccagtggggacactcctccctccccagtgagcagaaggcaccgtggtggtggctctgccccttgctgcagtgagcccaccttgctgcaacattggttctgaggggcccaagagatggcgtcttggtcatttgcccgcatggttgggcagttggttgaggccatgaacagaacttacggtaacaggcac

SEQ ID NO: 172737 - DNA, 1000 bp, Homo sapiens
  Payload ID: 13956
  Gene Symbol: PYCRL
  Gene Name: pyrroline-5-carboxylate reductase-like
  Uniprot ID: Q53H96
  ENST ID: ENST00000433751
  CDS Start-End: 22-786
agcggcgtccgaggcaacaagatggcagctgcggagccgtctccgcggcgcgtgggcttcgtgggcgcgggccgcatggcgggggccatcgcgcagggcctcatcagagcaggaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtcaagatgggcatgcccagcagcctggcccaccgcatcgctgcccagaccctgctggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtaggctgggctctggccatcctttcctgcctctgtgcccctgcctctccctgtgtcccttcccctgaggactgcggctccctccctcctgcatgagggtctcctactgctccttctccccttgcacagggaaatgcagggggcaggacttgggaggttccagcaggcgggggagccccgaccagtggggacactcctccctccccagtgagcagaag

SEQ ID NO: 172738 - DNA, 579 bp, Homo sapiens
  Payload ID: 13956
  Gene Symbol: PYCRL
  Gene Name: pyrroline-5-carboxylate reductase-like
  ENST ID: ENST00000462036
  CDS Start-End: 403-579
agaggtactgcctcttctgctccaggcagccttcccttccctggaggcagaggccccagggatctgtgtcctcaccaatgaggaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggagctgctgcccccaaacacacgggtgctgcgggtcttgcccaacctgccctgtgtggtccaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtc

SEQ ID NO: 172739 - DNA, 2332 bp, Homo sapiens
  Payload ID: 13956
  Gene Symbol: PYCRL
  Gene Name: pyrroline-5-carboxylate reductase-like
  Uniprot ID: Q53H96
  ENST ID: ENST00000495276
  CDS Start-End: 27-851
agcgcagcggcgtccgaggcaacaagatggcagctgcggagccgtctccgcggcgcgtgggcttcgtgggcgcgggccgcatggcgggggccatcgcgcagggcctcatcagagcaggaaaagtggaagctcagcacatactggccagtgcaccaacagacaggaacctatgtcactttcaagctctgggttgccggaccacgcactccaaccaggaggtgctgcagagctgcctgctcgtcatctttgccaccaagcctcatgtgctgccagctgtcctggcagaggtggctcctgtggtcaccactgaacacatcttggtgtccgtggctgctggggtgtctctgagcaccctggaggagctgctgcccccaaacacacgggtgctgcgggtcttgcccaacctgccctgtgtggtccaggaaggggccatagtgatggcgcggggccgccacgtggggagcagcgagaccaagctcctgcagcatctgctggaggcctgtgggcggtgtgaggaggtgcctgaagcctacgtcgacatccacactggcctcagtggcagtggcgtggccttcgtgtgtgcattctccgaggccctggctgaaggagccgtcaagatgggcatgcccagcagcctggcccaccgcatcgctgcccagaccctgctggggacggccaagatgctgctgcacgagggccaacacccagcccagctgcgctcagacgtgtgcaccccgggtggcaccaccatctatggactccacgccctggagcagggcgggctgcgagcagccaccatgagcgccgtggaggctgccacctgccgggccaaggagctcagcagaaagtaggctgggctctggccatcctttcctgcctctgtgcccctgcctctccctgtgtcccttcccctgaggactgcggctccctccctcctgcatgagggtctcctactgctccttctccccttgcacagggaaatgcagggggcaggacttgggaggttccagcaggcgggggagccccgaccagtggggacactcctccctccccagtgagcagaaggcaccgtggtggtggctctgccccttgctgcagtgagcccaccttgctgcaacattggttctgaggggcccaagagatggcgtcttggtcatttgcccgcatggttgggcagttggttgaggccatgaacagaacttacggtaacaggcacggctggcccaatgcctggtctggagctggagcttgcctttggctttccaggtggctccgtgcagctacagccaggccggctgcctcatctcagctctagggggcacgagccatatggggtctgcacaagagaccctctcccctgcagtaaagccaggggccctggcctgatggggcccccatggggagctggagcctgccctgcagcctggagaagagggtggctgtggtgggcgtgctcatcccctgctaaggagcaggagctgctgggccaggtctgcggcagtgctggggtggcaccaggtgggcagtggtaggtggggtggcttgaggtctgggagggtggccctggccagccaggacacatgcagacccctggctttagtctggatacaggctccctctttcctcccaatcctaagctcctgacaagtggccaggtggctctgggccctcctgccccgtgcctaggtcaggggtcctggaataccccgtagctctggcaccaccacactggcctctgatggcaagacttggcccctccacctgtccctaacggacggcaggtcaggaaagccaggactcaggggagaagcaaacccccaggattgaaggctagggttctagggcctttgggtggggagggcccgggccggacagcctcagctccgtcccctgccccacaagattcacctgggcctccagtcccacgctggccccaactgctgcagctctcggcttccgcccaacagcctctggaggtgaggcgggagcatgccctcagcgaggctgggcggcgggtcctgctgtgccatctccctgtgcgcctgagcagatcaatccaccagtgcaaaacagggctaacggcacctgcaggacagcagcacgctccatccctcatgctcagctgcctctgcggccacggacttctgcccttcatctgctctctcttactctcctgagcctagcccgtccgtaagctccctcccctgcctggttcccagggcaggctgactcagttgactgcttggtccaagcctggccctggcacttgtcagggtcagcctaaggagatgggaataaagaggccagagagcaccaagtgagctcatgtttc

SEQ ID NO: 172740 - DNA, 2678 bp, Homo sapiens; identical to SEQ ID NO: 172734
  Payload ID: 13956
  Gene Symbol: PYCRL
  Gene Name: pyrroline-5-carboxylate reductase-like
  ENST ID: ENST00000616663
  CDS Start-End: 31-891

SEQ ID NO: 172741 - DNA, 985 bp, Homo sapiens; identical to SEQ ID NO: 172735
  Payload ID: 13956
  Gene Symbol: PYCRL
  Gene Name: pyrroline-5-carboxylate reductase-like
  ENST ID: ENST00000634183
  CDS Start-End: 419-832

SEQ ID NO: 172742 - DNA, 2332 bp, Homo sapiens; identical to SEQ ID NO: 172739
  Payload ID: 13956
  Gene Symbol: PYCRL
  Gene Name: pyrroline-5-carboxylate reductase-like
  Uniprot ID: Q53H96
  ENST ID: ENST00000632107
  CDS Start-End: 27-851

SEQ ID NO: 172743 - DNA, 1324 bp, Homo sapiens; identical to SEQ ID NO: 172736
  Payload ID: 13956
  Gene Symbol: PYCRL
  Gene Name: pyrroline-5-carboxylate reductase-like
  ENST ID: ENST00000633357
  CDS Start-End: 22-156

SEQ ID NO: 172744 - DNA, 579 bp, Homo sapiens; identical to SEQ ID NO: 172738
  Payload ID: 13956
  Gene Symbol: PYCRL
  Gene Name: pyrroline-5-carboxylate reductase-like
  ENST ID: ENST00000633497
  CDS Start-End: 403-579

SEQ ID NO: 172745 - DNA, 1000 bp, Homo sapiens; identical to SEQ ID NO: 172737
  Payload ID: 13956
  Gene Symbol: PYCRL
  Gene Name: pyrroline-5-carboxylate reductase-like
  Uniprot ID: Q53H96
  ENST ID: ENST00000631620
  CDS Start-End: 22-786

SEQ ID NO: 172746 - DNA, 4004 bp, Homo sapiens
  Payload ID: 13957
  Gene Symbol: PC
  Gene Name: pyruvate carboxylase
  Uniprot ID: P11498
  ENST ID: ENST00000393955
  CDS Start-End: 82-3618
caggcagcaggcctcaggcccagacttgggtgttacaggaacagtgtggcctctctggaactctgcagaccaactgccgtgatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgccctccatgctgga

SEQ ID NO: 172747 - DNA, 4005 bp, Homo sapiens
  Payload ID: 13957
  Gene Symbol: PC
  Gene Name: pyruvate carboxylase
  Uniprot ID: P11498
  ENST ID: ENST00000393958
  CDS Start-End: 95-3631
gtcagtggaggcagcagcggtagaggcggcggcgaggactggcgacggcgaggagatagtgtctgccttctggagagctgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgcc

SEQ ID NO: 172748 - DNA, 4192 bp, Homo sapiens
  Payload ID: 13957
  Gene Symbol: PC
  Gene Name: pyruvate carboxylase
  Uniprot ID: P11498
  ENST ID: ENST00000393960
  CDS Start-End: 283-3819
gtcagtggaggcagcagcggtagaggcggcggcgaggactggcgacggcgaggagctgccttctagtctcacctgtggacactttgccaaaggagtcgggcctgacggtggaagatgggaaatggccaaaagaataaaccatttcctcttacttaccgaatgaaaagcttgcttcatcttggcgttcaagactctctaatatgattccacctgttgggctctttcttccatttgcctccgcagatagtgtctgccttctggagagctgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaagaccaacatcgccttcctgcagaatgtgctcaacaaccagcagttcctggcaggcactgtggacacccagttcatcgacgagaacccagagctgttccagctgcggcctgcacagaaccgggcccaaaagctgttgcactacctcggccatgtcatggtaaacggtccaaccaccccgattcccgtcaaggccagccccagccccacggaccccgttgtccctgcagtgcccataggcccgcccccggctggtttcagagacatcctgctgcgagaggggcctgagggctttgctcgagctgtgcggaaccacccggggctgctgctgatggacacgaccttcagggacgcccaccagtcactgctggccactcgtgtgcgcacccacgatctcaaaaagatcgccccctatgttgcccacaacttcagcaagctcttcagcatggagaactggggaggagccacgtttgacgtcgccatgcgcttcctgtatgagtgcccctggcggcggctgcaggagctccgggagctcatccccaacatccctttccagatgctgctgcggggggccaatgctgtgggctacaccaactacccagacaacgtggtcttcaagttctgtgaagtggccaaagagaatggcatggatgtcttccgtgtgtttgactccctcaactacttgcccaacatgctgctgggcatggaggcggcaggaagtgccggaggcgtggtggaggctgccatctcatacacgggcgacgtggccgaccccagccgcaccaagtactcactgcagtactacatgggcttggccgaagagctggtgcgagctggcacccacatcctgtgcatcaaggacatggccgggctgctgaagcccacggcctgcaccatgctggtcagctccctccgggaccgcttccccgacctcccactgcacatccacacccacgacacgtcaggggcaggcgtggcagccatgctggcctgtgcccaggctggagctgatgtggtggatgtggcagctgattccatgtctgggatgacttcacagcccagcatgggggccctggtggcctgtaccagagggactcccctggacacagaggtgcccatggagcgcgtgtttgactacagtgagtactgggagggggctcggggactgtacgcggccttcgactgcacggccaccatgaagtctggcaactcggacgtgtatgaaaatgagatcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgc

SEQ ID NO: 172749 - DNA, 1714 bp, Homo sapiens
  Payload ID: 13957
  Gene Symbol: PC
  Gene Name: pyruvate carboxylase
  ENST ID: ENST00000524491
  CDS Start-End: 215-1684
gtcagtggaggcagcagcggtagaggcggcggcgaggactggcgacggcgaggagatagtgtctgccttctggagagctgaccaaacactaaggatgctgaagttccgaacagtccatgggggcctgaggctcctgggaatccgccgaacctccaccgcccccgctgcctccccaaatgtccggcgcctggagtataagcccatcaagaaagtcatggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaaggtcagaagacaccaggcacagcccttggccgcagccctgggccgcccctgtggacaggaagccaggaggccccaggctgctgtgactgcccccaccggccctggtagccccacccttgtccgtgtgccaccagcggcccgtgtcctgtcctcccgtctcgggggacctagccagacaacaccagagactagcactgaggtgtccccaacaattttattataaataaaaacaagactcccagtgggtggctgc

SEQ ID NO: 172750 - DNA, 1607 bp, Homo sapiens
  Payload ID: 13957
  Gene Symbol: PC
  Gene Name: pyruvate carboxylase
  ENST ID: ENST00000529047
  CDS Start-End: 45-941
tcccagggggccagtacaccaacctgcacttccaggcccacagcatggggcttggctccaagttcaaggaggtcaagaaggcctatgtggaggccaaccagatgctgggcgatctcatcaaggtgacgccctcctccaagatcgtgggggacctggcccagtttatggtgcagaatggattgagccgggcagaggccgaagctcaggcggaagagctgtcctttccccgctccgtggtggagttcctgcagggctacatcggtgtcccccatggggggttccccgaaccctttcgctctaaggtactgaaggacctgccaagggtggaggggcggcctggagcctccctccctcccctggatctgcaggcactggagaaggagctggtagaccggcatggggaggaggtgacgccggaagatgtgctctcagcagctatgtaccccgatgtgtttgcccacttcaaggacttcactgccacctttggccccctggatagcctgaatactcgcctcttcctgcagggacccaagatcgcagaggagtttgaggtggagctggagcggggcaagacgctgcacatcaaagccctggccgtgagcgacctgaaccgggccggccagaggcaggtcttctttgagctcaatgggcagctgcggtccatcttggtcaaggacacccaggccatgaaggagatgcacttccaccccaaggccctaaaggacgtgaagggccagatcggggcgcccatgcctgggaaggtgatagacatcaaagtggtggcaggggccaaggtggccaagggccagcccctgtgtgtgctcagtgccatgaagatggagactgtggtgacctcacccatggagggtactgtccgcaaggttcatgtgaccaaggacatgacactggaaggtgacgacctcatcctggagatcgagtgatcttgccccagaccggcagcctggccatccccaagccttcaacagaagctgtgctgccacggcaggcccaggccagccagtgcccgaggccaggaaggccgggccgtggaggtcctgtccacagctggacaggagagacaccgcctgcggtggttcattcctttcagccatcgtcctttcctccggcggacagctgcttacatgttcatctcttgccaaataagggtcccctcctcactggagactacaagtggtgggtcaggtggtcctaggacccaggggaggtttaggggtcctatctcctgggggaaggggagatctaagatgtcccaggtcctgggaagtttactcaataaagctggctttcccctgccctccatgctggatcctgtgcagcccccagcctgcaccactcagcagtggggggctgcctttcaagctccccatgggtgggcaggtcagttgtgtcgttctcctcagagggtagtgagaatgaccatcgtggccctgttttaagtcactattgggtgcctactgtgtatactccccaaacaggactagtagtactgaacttgcttgaggggtggggcctgttctaagtatttaacacctattaacacagggaattaaccttcatcctcttatggacacagaaatcaagtcaca

SEQ ID NO: 172751 - DNA, 1470 bp, Homo sapiens
  Payload ID: 13957
  Gene Symbol: PC
  Gene Name: pyruvate carboxylase
  ENST ID: ENST00000628663
  CDS Start-End: 1-1470
atggtggccaacagaggtgagattgccatccgtgtgttccgggcctgcacggagctgggcatccgcaccgtagccatctactctgagcaggacacgggccagatgcaccggcagaaagcagatgaagcctatctcatcggccgcggcctggcccccgtgcaggcctacctgcacatcccagacatcatcaaggtggccaaggagaacaacgtagatgcagtgcaccctggctacgggttcctctctgagcgagcggacttcgcccaggcctgccaggatgcaggggtccggtttattgggccaagcccagaagtggtccgcaagatgggagacaaggtggaggcccgggccatcgccattgctgcgggtgttcccgttgtccctggcacagatgcccccatcacgtccctgcatgaggcccacgagttctccaacacctacggcttccccatcatcttcaaggcggcctatgggggtggagggcgtggcatgagggtggtgcacagctacgaggagctggaggagaattacacccgggcctactcagaggctctggccgcctttgggaatggggcgctgtttgtggagaagttcatcgagaagccacggcacatcgaggtgcagatcttgggggaccagtatgggaacatcctgcacctgtacgagcgagactgctccatccagcggcggcaccagaaggtggtcgagattgcccccgccgcccacctggacccgcagcttcggactcggctcaccagcgactctgtgaaactcgctaaacaggtgggctacgagaacgcaggcaccgtggagttcctggtggacaggcacggcaagcactacttcatcgaggtcaactcccgcctgcaggtggagcacacggtcacagaggagatcaccgacgtagacctggtccatgctcagatccacgtggctgagggcaggagcctacccgacctgggcctgcggcaggagaacatccgcatcaacgggtgtgccatccagtgccgggtcaccaccgaggaccccgcgcgcagcttccagccggacaccggccgcattgaggtgttccggagcggagagggcatgggcatccgcctggataatgcttccgccttccaaggagccgtcatctcgccccactacgactccctgctggtcaaagtcattgcccacggcaaagaccaccccacggccgccaccaagatgagcagggcccttgcggagttccgcgtccgaggtgtgaaggtcagaagacaccaggcacagcccttggccgcagccctgggccgcccctgtggacaggaagccaggaggccccaggctgctgtgactgcccccaccggccctggtagccccacccttgtccgtgtgccaccagcggcccgtgtcctgtcctcccgtctcgggggacctagccagacaacaccagagactagcactgaggtgtccccaacaattttattataa

SEQ ID NO: 172752 - DNA, 699 bp, Homo sapiens
  Payload ID: 13958
  Gene Symbol: PDHA1
  Gene Name: pyruvate dehydrogenase (lipoamide) alpha 1
  ENST ID: ENST00000355808
  CDS Start-End: 89-699
gctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcagtttctccttcctctaacacaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatgg

SEQ ID NO: 172753 - DNA, 709 bp, Homo sapiens
  Payload ID: 13958
  Gene Symbol: PDHA1
  Gene Name: pyruvate dehydrogenase (lipoamide) alpha 1
  ENST ID: ENST00000379804
  CDS Start-End: 189-518
gaaacattggagagtttcattctcatacaggagcaggtcatgtgaaagtaaaatggtttggggcagttggattcatgcttcgcccctcccctgtttattaccaggtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtg

SEQ ID NO: 172754 - DNA, 734 bp, Homo sapiens
  Payload ID: 13958
  Gene Symbol: PDHA1
  Gene Name: pyruvate dehydrogenase (lipoamide) alpha 1
  ENST ID: ENST00000379805
  CDS Start-End: 71-613
gacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtagtcaaggacgaggattgtgtgctgctttagatttggccctggactttgtcttcaaaaactttcacagccccagacaacttttcctgaagtagtacagccatgtgctgcacagtgacgctttggtcaatgtcgcatatatgatgttggaccc

SEQ ID NO: 172755 - DNA, 3484 bp, Homo sapiens
  Payload ID: 13958
  Gene Symbol: PDHA1
  Gene Name: pyruvate dehydrogenase (lipoamide) alpha 1
  Uniprot ID: P08559
  ENST ID: ENST00000379806
  CDS Start-End: 146-1432
agcgcatgacgttattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccgagacatggtcttgctacgttgcccagtctggtctccatctccaggctcaagcagtcctcccacctcggcctcccaaagtgctgggattactctcactctcttaaaaccaggcaggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctgggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatg

SEQ ID NO: 172756 - DNA, 3310 bp, Homo sapiens
  Payload ID: 13958
  Gene Symbol: PDHA1
  Gene Name: pyruvate dehydrogenase (lipoamide) alpha 1
  Uniprot ID: P08559
  ENST ID: ENST00000422285
  CDS Start-End: 106-1278
actgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctgggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaa

SEQ ID NO: 172757 - DNA, 471 bp, Homo sapiens
  Payload ID: 13958
  Gene Symbol: PDHA1
  Gene Name: pyruvate dehydrogenase (lipoamide) alpha 1
  ENST ID: ENST00000417819
  CDS Start-End: 109-471
gcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccgtttgcagggtccccccccccccgccaccttacagtaggaagaaaattgagttccagatatgaagtcacctttgaaagtgcccaggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttg

SEQ ID NO: 172758 - DNA, 731 bp, Homo sapiens
  Payload ID: 13958
  Gene Symbol: PDHA1
  Gene Name: pyruvate dehydrogenase (lipoamide) alpha 1
  ENST ID: ENST00000423505
  CDS Start-End: 117-731
gccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccgagacatggtcttgctacgttgcccagtctggtctccatctccaggctcaagcagtcctcccacctcggcctcccaaagtgctgggattactctcactctcttaaaaccaggcaggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtg

SEQ ID NO: 172759 - DNA, 3391 bp, Homo sapiens
  Payload ID: 13958
  Gene Symbol: PDHA1
  Gene Name: pyruvate dehydrogenase (lipoamide) alpha 1
  Uniprot ID: P08559
  ENST ID: ENST00000545074
  CDS Start-End: 146-1339
agcgcatgacgttattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcagtttctccttcctctaacacaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctgggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatg

SEQ ID NO: 172760 - DNA, 3277 bp, Homo sapiens
  Payload ID: 13958
  Gene Symbol: PDHA1
  Gene Name: pyruvate dehydrogenase (lipoamide) alpha 1
  Uniprot ID: P08559
  ENST ID: ENST00000540249
  CDS Start-End: 146-1225
agcgcatgacgttattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgcttaaagattatttttgacttaaaatagtatactttgaacaaatactctaattatgaaaaggaagaacaattccttgtatgcctgtttcccctgcccccagccacctttttgggaggagaccattatggcggggcccctcacagcattctaccaaccatagcacccaccccgagcagcgctggtgctgcagcctgttcgcgctgaccatttctctacaagatacaatatttattatcaggcaagaggacagttccattttaaaataagacttttgtaatcattccaattttgtaatcatttcaaaggccacataacttagttttctctacttacacattcagtataaatatgaagctattttctgttcatatcaaacattaactacaaggcacattcgtatcagttttgtgtttctcaaattgaagtaccataccagttctgaggcagtgtcccagcttccatgtttgttaaataccccttgtttgtttcaccattccagcaagtgctgaagggtgtactttttttgagacagggtcgggctctgttgcccaggctggagtgcagtggtgtgatcatggctcactgcagcctccacacctcctgggctcaagcaatcctcccacctcagcctcctgcatagctgggactacaagtgaatttcctaatattccgggaggtcaaaaccaaggctcactgttttcacaatacacacagttctatgtttataaataacaggtttcaaaagaaactcaggacagtatttaaaacaagttcttaaactattaattgaacaatggcatttttaaatatgtaaacacagcggaattcgtgtatacactaacagaagctttaacaaaacatgtagcgtggtgggacactctgccacagcttagctgattggtatcaagccttgtctttggtttctgaggcctcctgagcccttctgtactgggagaccgcactccagagtctgcagaggagaccacccctgggaaacaaacacagctgtcttcagagtcagtgcttcaagccaacagagcttaaaactgcagtccctaatttaaaaacctaatgaaaataaaaacattctcctcacatatggaggtgacgctcgtgtcccagcagtagtaggacatggccttagaggtacgtacctgcagagagctggctatttcaaatgactcgggaacaagaaggcaggctgcagtttaaagaagggggtgggtccagcgtgcaggcacgcttgccatgtgcctccacccactcccagccaggcattaatggcaggagattggccagctcttctctgtcacattcctatttctgacttctgcctggctttcagtttctgccccaccttggctttttcccagcttgaacctaatagaactccagagtttggggggaggcccagccctttgttttctgctcttgaagcatattcacacataaaaagttgtattctcttatacaaactgttttgaggctcttaccgtagtcgaaggtatcttagatcttccttagtgatctcattaagaatatccgaaagtgtataaccctcttcaacaatctgaaacaaagatcagatccttaagagctgagcagctgtgtaacaacagcataagaatttctttgttgtaaatttaccttttcaattgtctttgcatcagctccttgcagccgcaaccagtctataagctctttatctgttctctgcccgtaggggcctgctgggttctctgtaatacctgtaacgattggcaatttgttatatattagtctaaccataaaactcttcaaaagtaaccagttggattaataaatgattccagaatgtaaatgtgatgtgaaaaagagatg

SEQ ID NO: 172761 - DNA, 1456 bp, Homo sapiens
  Payload ID: 13959
  Gene Symbol: PDHA2
  Gene Name: pyruvate dehydrogenase (lipoamide) alpha 2
  Uniprot ID: P29803
  ENST ID: ENST00000295266
  CDS Start-End: 133-1299
tctatcacccgtgtgcactgcccggatggtgccaagcgcattggagcaccggaaggagacgcggagccgaggccaggccttccggcggtcgttacgggacgccgctgccatctacagcactccgtgaagaatatgctggccgccttcatctcccgcgtgttgaggcgagttgcccagaaatcagctcgcagagtgctggtggcatcccgtaactcctcaaatgacgctacatttgaaattaagaaatgtgatctttatctgttggaagagggtccccctgtcactacagtgctcactagggcggaggggcttaaatactacaggatgatgctgactgttcgccgcatggaattgaaggcagatcagctgtacaaacagaaattcattcgcggtttctgtcacctgtgcgatggtcaggaagcttgttgcgtgggccttgaggccggcataaacccctcggatcacgtcattacatcctatagggctcatggtgtgtgctatactcggggactttctgtccgatccattctcgcagagctgacgggaagaagaggaggttgtgctaaaggaaaaggaggatcgatgcatatgtataccaagaacttctatgggggcaatggcatcgtcggtgcacagggccccctgggcgctggcattgctctggcctgtaaatataaaggaaacgatgagatctgtttgactttatatggggatggcgctgcgaatcaggggcagatagccgaagctttcaatatggcagctttatggaaattaccttgtgttttcatctgtgagaataacctatatggaatgggaacatctactgagagagcagcagccagccctgattactacaagaggggcaattttatccctgggctaaaggtcgatggaatggatgttctgtgtgttcgtgaggcaacaaaatttgcagctaactactgtagatctggaaaggggcccatactgatggagctgcaaacctaccgttatcatggacacagtatgagtgatcctggagtcagttatcgtacacgagaagaaattcaggaagtaagaagtaagagggatcctataataattctccaagatagaatggtaaacagcaagctcgccactgtggaagaattaaaggaaattggggctgaggtgaggaaagaaattgatgatgctgcccagtttgctaccactgatcctgagccacatttggaagaattaggccatcacatctacagcagtgattcatcttttgaagttcgtggtgcaaatccatggatcaagtttaagtccgtcagttaaagggaggctacgtgtgaatttatcatcagtctctcaatggaatgttcatggtcaaatttaagaaactgtgttctcaactcaaggaggaataaaactcataaaacaaaagccttgtaagcatttattaaaagagattattaaaagagattgaaagaca

SEQ ID NO: 172762 - DNA, 1527 bp, Homo sapiens
  Payload ID: 13960
  Gene Symbol: PDHB
  Gene Name: pyruvate dehydrogenase (lipoamide) beta
  Uniprot ID: P11177
  ENST ID: ENST00000302746
  CDS Start-End: 44-1123
cccctctgttgtcgtttggcagcggatagaggacacgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagagggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctcatgaaagatgtatccaaacaagataacttatatgtataaaattaaagcatataatatacatttactgttagtttgttttgataaggaataaaggaatttctaacatga

SEQ ID NO: 172763 - DNA, 1478 bp, Homo sapiens
  Payload ID: 13960
  Gene Symbol: PDHB
  Gene Name: pyruvate dehydrogenase (lipoamide) beta
  Uniprot ID: P11177
  ENST ID: ENST00000383714
  CDS Start-End: 49-1074
gccggcccctctgttgtcgtttggcagcggatagaggacacgaccaagatggcggcggtgtctggcttggtgcggagaccccttcgggaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagagggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctcatgaaagatgtatccaaacaagataacttatatgtataaaattaaagcatataatatacatttactgttagtttgttttgataaggaataaaggaatttctaacatga

SEQ ID NO: 172764 - DNA, 1397 bp, Homo sapiens
  Payload ID: 13960
  Gene Symbol: PDHB
  Gene Name: pyruvate dehydrogenase (lipoamide) beta
  Uniprot ID: P11177
  ENST ID: ENST00000485460
  CDS Start-End: 10-1035
acgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctcatgaaagatgtatccaaacaagataacttatatgtataaaattaaagcatataatatacatttact

SEQ ID NO: 172765 - DNA, 1503 bp, Homo sapiens
  Payload ID: 13960
  Gene Symbol: PDHB
  Gene Name: pyruvate dehydrogenase (lipoamide) beta
  ENST ID: ENST00000474765
  CDS Start-End: 6-1058
ccaagatggcggcggtgtctggcttggtgcggagaccccttcgggaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagagggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtatttcaaagaaactggttctagaatacagtcaagctatagtaaacatcatgtacctgaatacgtacaggataaagagattgaaagctaggagtggccaaacgacttcaactttaaacttgtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctcatgaaagatgtatccaaacaagataacttatatgtataaaattaaagcatataat

SEQ ID NO: 172766 - DNA, 1616 bp, Homo sapiens
  Payload ID: 13960
  Gene Symbol: PDHB
  Gene Name: pyruvate dehydrogenase (lipoamide) beta
  ENST ID: ENST00000469364
  CDS Start-End: 12-767
acacgaccaagatggcggcggtgtctggcttggtgcggagaccccttcgggaggtctccgggctgctgaagaggcgctttcactggaccgcgccggctgcgctgcaggtgacagttcgtgatgctataaatcagggtatggatgaggagctggaaagagatgagaaggtatttctgcttggagaagaagttgcccagtatgatggggcatacaaggttagtcgagggctgtggaagaaatatggagacaagaggattattgacactcccatatcagagatgggctttgctggaattgctgtaggtgcagctatggctgggttgcggcccatttgtgaatttatgaccttcaatttctccatgcaagccattgaccaggttataaactcagctgccaagacctactacatgtctggtggccttcagcctgtgcctatagtcttcagagggcccaatggtgcctcagcaggtgtagctgcccagcactcacagtgctttgctgcctggtatgggcactgcccaggcttaaaggtggtcagtccctggaattcagaggatgctaaaggacttattaaatcagccattcgggataacaatccagtggtggtgctagagaatgaattgatgtatggggttccttttgaatttcctccggaagctcagtcaaaagattttctgattcctattggaaaagccaaaatagaaaggcaaggaaggctgccacattcctcagctcactggaatgaagttgaattgaagactttatgaatgaacaagagccacagctggcggcacagtggtgtagcatcttcagtttcaacctgatctctgatctgtgaccactctgttttcaggaacacatataactgtggtttcccattcaagacctgtgggccactgcttagaagctgcagcagtgctatctaaagaaggagttgaatgtgaggtgataaatatgcgtaccattagaccaatggacatggaaaccatagaagccagtgtcatgaagacaaatcatcttgtaactgtggaaggaggctggccacagtttggagtaggagctgaaatctgtgccaggatcatggaaggtcctgcgttcaatttcctggatgctcctgctgttcgtgtcactggtgctgatgtccctatgccttatgcaaagattctagaggacaactctatacctcaggtcaaagacatcatatttgcaataaagaaaacattaaatatttagtttggacttgaatatcaagtcgttgaaatttatttgaaatacttgctggcactgcacctggatttgtactgcaagacctgactattcataacggaaaacgatttctaaagcaacagcaggtatttttgtacagggaagtttaaatgtgtttgtgtatggaaaactctccactctcctcccctagatgccatgcttccttttgtctgttacggttgccatgttctttgaataacaaattatataacattttatcctctctcaccacaaggacaaagtatggatgtggcagagtcctcatgaaagatgtatccaaacaagataacttatatgtataaaattaaagcatataatatacatttactgttagtttgttttgataagga

SEQ ID NO: 172767 - DNA, 2389 bp, Homo sapiens
  Payload ID: 13961
  Gene Symbol: PDHX
  Gene Name: pyruvate dehydrogenase complex, component X
  Uniprot ID: O00330
  ENST ID: ENST00000227868
  CDS Start-End: 85-1590
gggcgtggccaaccatgcgggaggcggggccttgatgctggacatcaggctgtgctgcgggcagccagtgagaaggccgtcaagatggcggcctcctggaggctgggctgtgatccgcggctgctgcgttatcttgtgggcttccccggccgccgaagcgtagggctggtgaagggggctcttgggtggtctgtaagccgcggagctaattggagatggtttcacagcacgcagtggcttcggggtgatcccattaagatactaatgccatcactgtctcctacaatggaagaaggaaacattgtgaaatggctgaaaaaggaaggtgaagcggtgagtgctggagatgcattatgtgaaattgagactgacaaagctgtggttaccttagatgcaagtgatgatggaatcttggccaaaatcgtggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggttccgtttaagtccagctgcccgcaatattctggaaaaacactcactggatgctagccagggcacagccactggccctcgggggatattcactaaagaggatgctctcaaacttgtccagttgaaacaaacgggcaagattaccgagtccagaccaactccagcccccacagccactcccacagcaccttcgcccctacaggccacagctggaccatcttatccccggcctgtgatcccaccagtatcaactcctggacaacccaatgcagtgggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaagatgacattaaagtatcagtaaatgattttatcatcaaggcagcagctgttacccttaaacaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagcaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgccaa

SEQ ID NO: 172768 - DNA, 2653 bp, Homo sapiens
  Payload ID: 13961
  Gene Symbol: PDHX
  Gene Name: pyruvate dehydrogenase complex, component X
  Uniprot ID: O00330
  ENST ID: ENST00000448838
  CDS Start-End: 243-1703
aaacgcccggcccgctaccctgcgcccagctccagccgccgggtcccgcctgggcctctcctcctgggaataccgggcaccggtggccccgcccctacctgcgcgccgcatctccgggaacaacagtctccctcccgagcatcacagccagacatggcccagaccagggacccgcgcggcctccaatctccgcacggctttgcgcgcggcgcttagcctgggatacggcagcgaggccgcaaatgcaatcaggcggcgctgagggcagcccgggggcggggcgaacggggcgggggccggggtctggtaaggccccgccggctgagatatccagcggcgcacctgacttcccgggaggtgatcccattaagatactaatgccatcactgtctcctacaatggaagaaggaaacattgtgaaatggctgaaaaaggaaggtgaagcggtgagtgctggagatgcattatgtgaaattgagactgacaaagctgtggttaccttagatgcaagtgatgatggaatcttggccaaaatcgtggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggttccgtttaagtccagctgcccgcaatattctggaaaaacactcactggatgctagccagggcacagccactggccctcgggggatattcactaaagaggatgctctcaaacttgtccagttgaaacaaacgggcaagattaccgagtccagaccaactccagcccccacagccactcccacagcaccttcgcccctacaggccacagctggaccatcttatccccggcctgtgatcccaccagtatcaactcctggacaacccaatgcagtgggcacattcactgaaatccccgccagcaatattcgaagagttattgccaagagattaactgaatctaaaagtactgtacctcatgcatatgctactgctgactgtgaccttggagctgttttaaaagttaggcaagatctggtcaaagatgacattaaagtatcagtaaatgattttatcatcaaggcagcagctgttacccttaaacaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtggatgaaatgtttatttatttaaggtgaaagcatttgacccagggtgtcttcatcttcaatttgggtttaatgttatagaaataaatgatgataaactctaactaataaaggaaagagaatatttggttactcagatccatttttaacctctggtgctgtataaagggaatattaaactagatgtaaatcaaagtatatgtttggctcatttgagcattttggaatatttgagaatgtatgatacatgtaaaattaaaaaaactattagaactgtaccataattatgttgaaggtagaagtgatcttcaaagagatggccattaacttagcagtgggacctcacttttacaagcactgctctagatatacttgaagaatttaataggtacagaagtttattctggataataaataaataaggatcacactgtattaggggttatggcaacattattgaattttttatgtacataaagccatatgtttagggtggtttctatctgtcttgtttttcacttatataacactgtgaacttctaaagcaagaggataaaagaagcatgaatgaaaagaatgacatttcaaaaaaatggttcaatgaaaaactatagctaaaatatgtaaacctttctaggtaaaccgcttgccttcatcttgagtcggaatatatttaaataaattgtgttatctcttgccaaacattttgttagtgtttatttaaaaacaaaatgttgtttcttaatgcatttaaatcagttttgtattgtgcagtaaaatgtgagaaaatataaacatttctattgtattttaaatgttaaaacacaaaagttcaataaaccttgaagttga

SEQ ID NO: 172769 - DNA, 952 bp, Homo sapiens
  Payload ID: 13961
  Gene Symbol: PDHX
  Gene Name: pyruvate dehydrogenase complex, component X
  Uniprot ID: O00330
  ENST ID: ENST00000430469
  CDS Start-End: 25-849
gcagccagtgagaaggccgtcaagatggcggcctcctggaggctgggctgtgatccgcggctgctgcgttatcttgtgggcttccccggccgccgaagcgtagggctggtgaagggggctcttgggtggtctgtaagccgcggagctaattggagatggtttcacagcacgcagtggcttcggggtgatcccattaagatactaatgccatcactgtctcctacaatggaagaaggaaacattgtgaaatggctgaaaaaggaaggtgaagcggtgagtgctggagatgcattatgtgaaattgagactgacaaagctgtggttaccttagatgcaagtgatgatggaatcttggccaaaatcgtgcaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctcaaagataagaagttggtgttcagcttagttgattcagtagttgttaccaagaaacatatgttataggaaaacaacttggtatttaagtatgaagtgga

SEQ ID NO: 172770 - DNA, 584 bp, Homo sapiens
  Payload ID: 13961
  Gene Symbol: PDHX
  Gene Name: pyruvate dehydrogenase complex, component X
  ENST ID: ENST00000533550
  CDS Start-End: 131-584
aactggtcgtcagggcgcagaaaagaagcttggggggcgcggtcttcgccccagctccacttcggtgcttcacgattccttctctggcctgccttcctgataaatacccggtgatcccattaagatactaatgccatcactgtctcctacaatggaagaaggaaacattgtgaaatggctgaaaaaggaaggtgaagcggtgagtgctggagatgcattatgtgaaattgagactgacaaagctgtggttaccttagatgcaagtgatgatggaatcttggccaaaatcgtggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggttccgtttaagtccagctgcccgcaatattctggaaaaacactcactggatgctagccagggcacagccactggccctcgggggatattca

SEQ ID NO: 172771 - DNA, 561 bp, Homo sapiens
  Payload ID: 13961
  Gene Symbol: PDHX
  Gene Name: pyruvate dehydrogenase complex, component X
  ENST ID: ENST00000533262
  CDS Start-End: 16-561
gagaaggccgtcaagatggcggcctcctggaggctgggctgtgatccgcggctgctgcgttatcttgtgggcttccccggccgccgaagcgtagggctggtgaagggggctcttgggtggtctgtaagccgcggagctaattggagatggtttcacagcacgcagtggcttcggggtgaagcggtgagtgctggagatgcattatgtgaaattgagactgacaaagctgtggttaccttagatgcaagtgatgatggaatcttggccaaaatcgtggttgaagaaggaagtaaaaatatacggctaggttcactaattggtttgatagtagaagaaggagaagattggaaacatgttgaaattcccaaagacgtaggtcctccaccaccagtttcaaaaccttcagagcctcgcccctcaccagaaccacagatttccatccctgtcaagaaggaacacatacccgggacactacggttccgtttaagtccagctgcccgcaatattctggaaaaacactcactggatgctagccagggcacagccactggccctcggggg

SEQ ID NO: 172772 - DNA, 574 bp, Homo sapiens
  Payload ID: 13961
  Gene Symbol: PDHX
  Gene Name: pyruvate dehydrogenase complex, component X
  ENST ID: ENST00000526309
  CDS Start-End: 1-569
atcatttgtctttttcgagacataggaatgacattaaagtatcagtaaatgattttatcatcaaggcagcagctgttacccttaaacaaatgccagatgttaatgtaagctgggatggagagggcccaaagcaactgccatttattgacatttcagtggctgtggcaacagataaaggcttacttactccaatcataaaagatgctgctgctaaaggtatccaggaaattgctgactctgtaaaggctctatcaaagaaagcaagagatggaaaattgttgcctgaagaataccaaggaggatcttttagtatttccaacttggggatgtttggcatcgacgaatttactgcagtgattaaccctcctcaggcctgcattttggcggttgggaggttccgacctgtgctgaagctcactgaggatgaagagggaaatgccaaactgcagcagcgccagctcataacagtcacaatgtcaagtgacagtcgagtggttgatgacgaactggcaaccaggtttcttaaaagttttaaagcaaacctagagaatcctatccgacttgcctagtcctc

SEQ ID NO: 172773 - DNA, 14193 bp, Homo sapiens
  Payload ID: 13962
  Gene Symbol: PDK1
  Gene Name: pyruvate dehydrogenase kinase, isozyme 1
  Uniprot ID: Q15118
  ENST ID: ENST00000282077
  CDS Start-End: 183-1493
ctccttcccgctccgcgtcccgcccagcggcgcagggggccgggctccggctaggagggtgggggccgcgccggtgacagccgatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaaggtatggtgttcagaactatattataccaagtactttatttatcgttttcacaaaactatttgagtagaataaatggaaactgaattccatttgtgcccgttaaacctcctaaaggatgaaattgcacctattttacacttatattttcacagttaattgaacatatttttaaacaactgtagttttgggcaacttttcactttgtggtagacttcagaagtgtggaaatcttcgggtttctataggaaactagttttttttttttaagaaatactttcatttatgtttgctagaaacattttctaaatgatagtgattagctggttagccatcttcctgttatttggaggagttctgccatcttttattcggtagtgacagctgtaatatggtcttcatgtttatcagtgacttgactacaagtaaagcagaaaacagttggcctgtaatcacagaaccagccacccttcggcgtctacatgcattgtcttagctctgaggttaatttaccatttttaaattttattgtaaagaagtgtaatgactagctctctgtggatctatgccaaaatcatgggccatcttttctaagtgtacttctgattaatgcaaggggaaatttttatactgaaaacaaacaaacaaactagcagctactaaaatagagaagaaattgagggcaaagtaatatgtctccaaaactgaactgattgcttgttgagattacctagaaagcttttggaaaaaaatagagcttttctgcatcctactccagatacactgaatcggaatccctagggctagagcctagaaatctcactttttaaaatgcttccaaggtaagtctgatgcctaccctaggttgggaaccactctttcaaagtaaacagtgatgacacagcatttgctaaagtaacatctgtaggttttggtttccacctatttaaagtcagatttatagactcgaggagacagaaactgaatcccacacctggtgcaattagaagcataattagaagcagaagaacaaaatgccacgtaaccaaagcatcagagccatcattgcacgtgtctttttttcttttttcttttttttttttcaagacagggtctcgctcttttgcccaggatggagtacagtggcatggtcaaggctcactgcagcttcaatcttctgggctcaagtaatccttccacctcagcctcccatatagctggaactacagttgtgcactaccacacccagctaattttttgatttcttgtggagatgaggtctcagtatgttcccaggctagtgttgaactcctgagctcaagaaatcctcctgcctgagtctctgaaagtgctgggattacaggcgtgagccaccacacatggcctattgcacaagtcttgacaaacaacatatattttctaaaactatccagatttcattatcagggaaaagtttgcttaggtttattacagcagtccttggcatttgtatggtaatttgtactttacaaatactttgatatattataactctattggtctttgaaacaaagcgatacagtgtaggtggtatcattctctttctcactcagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaataactttccacagtataactgtaaaaaaaaaaaaaaaaagtcttaatttaaccagcattaccctctgcttgtaccaattgaatggcagaactactatagtcaaaaataaattcctatcctatttttaattgatgggatataggcagcacaatttcccttcattgttgaagccaacaagttccgtaacagaactccagaggtaaatagctgggaaaactgttagttttaaggtcccactgttgctctgtgaatgactaatcagaggaagccaaaaatcagccaactaatttcagtttatgtctttaattgtgatgtaagtgtgaagtttctacatatgggtaatcagggttgagttaggtagtttgcaaacatgacttttgctggaggaacttttaatcatgtcttattaatttctggtcccaataattaattttcttacagtcaaacccaatgcacttgaaaaataatataattaatactgtgtgaagaattttttgcatgttaaaaaaagcaaaccactagtttgcttagttctggcattcataaactactgtaccttctgttctattgacatgtttggaaaaaagaattgaacatatgtaccacccccctctttctagagtctccacagttctttagcaattgctaaccataggtttttaatagcaaaagacaagattgtcagtttttggtgcaaaactctactctttttggttgacttggaaaagctgttgtttatattgggaattgtgacagctgtcttttactttgttaaattagcaattatttagcaaaaatacagagtttcaccccagtaaaataaacttccacgtgagagttgtgttcattcaagggttattttttgagagtggaagtacatttcctgcatttgtcacagataatatcagaaattttgttgttttgattaaaatgttgccatctacttataagttaaaaatgctgagaaggttttttttggaaacagtttatgaggccaggacatttttaagtttgactcaaatataaaaagccacagtattcttgccatggttttgtacttagatgtctctcattatggaattcagaatgtgacagttatagtactacatgaaaatacttaatatagagttctacagttacagtattgcatgaaaatacagtatggtatgaaattatttgtccaaaactgtactccagaaatggagcccatatgattatataactataaaataggatgggacagagaaaaatatgtctgtattacagcataaacatatctggtttaatatgaactatttcttttcatctctttactctcagtatctccataatggccagtatgtagtaggcacctgtaattgtgaagcagcctcattgtctggggtaaataccaaggttcttggtctcatggccaaggagatcgaggtcgcagacacacacagtttggagcaggagtttaataggcaaaaggaaacagctctgttacagagaggggttccgagcaggttgccaagttgtagtaaaaatgtcagggtttttataaatgggctagtgaggagggggctcatgaggaggggatatcttatcctcctagggtccgaggacgctttagttgggaccaggtgtgctatctgtacagagcatagctttttatcagctcttatcccattccttgaccacataggctcttagactcttattctatgttgtcttcgtccagcttatctggaagggagagtttctctgtctgttcccatacatcttgcagctgcaggcatccccccggtctgcttttagcttccttatcttagtgcccctaaagggaaaggaatgtgcttattaagggccactgttttactggggttaactgcatgaggtcaaaaagagctatatttgagctgctgtttgttaaaagaaaagttttctgccggggactcgctttaccctgtctacctaaattctttctgccttctataacaattgtatgctcagtaaatacataaggaataatgaacttaataacatttttttccattctcaaaatgatacttaaatgactcagtacaacaaagaaactgagtagtaaccagtgcaaaactagcaaaaggatgaaatacacaagaaaatgagagaatttaagaggagtagcaaaacagcactgctaaagttacgggtttattttaaagtttaaaatagaagtaaacaagcaaacatactgataatggttaggctttctgtccccaccgcacaaatctcatcttgaattataatctcaacatgttaagggagagaccagatgaaagtaattggatcatggggttggtttctcccatgctgttctcgtgatagttcccatgagatctgatggttttataagtatttggtagttcctcctgcattcattcttcctgctgccctgtgaagaggtgccttccaccatgattgtgagtttctggaggcttctgcagccttgcggaactgtgagtcaatcctttttattataaattaccccgtctcaggcagttctttatagcagtgtggggatggactaatactcgctgggttagctggggtaggtaaagccacagctgtggcagcaaccagctagtgggtgtcccttgatggaggctttgcaggctgcagcagaagggacccttcagataaacctccagtcaggaaaggaaaaggcccaaataaacagtatttagatttttttttaaaggacataactaccaatagagatttaaaataatcataagaataccattaactttatgataaaaattttgtaagtggagaagaaatggatatatttctaggaaaacagtagaagatccatctaagattttgacaatttaaatcaaccactaaggaagtggaatcagtaatcacaagtccacctcgccaaaagacaatttttgaaagatgaatgttaccaaaacatcaagaaactgataattcctgtcttatagaaactttgaaatgagagaaagctacccaacccatttcagaaagttagtaaaatctcaaagctacacttgagcaaagactgtgaaatattaatagaccaatcttgtttatgaacatagatggaaaaattgctgatgaaatattggcacattgaatgtagcagtgcataaaatattgtatcatgagcaaaaggagaatctttcccaggaacaggaggatgttttaataaaaatatgtaatttacctctctacagattaaaggagaaaaactatatgatcacatcaacagaaacaggaaattcagtttctttgggggatagttgtaattaaaagtgcttaactcacttatataagccattagtggatgttacaataaacctcgtatagtgtcagatgtaagacagacatactggaattgtctatgaggttggatccatgggcctgccatggaaaatttgttgagtaatacgtccaaggcgtcaccatttgccaggcgttgcaagtatcaccatttgcaaggtgttaacaaaaagttacctgcctatggattctcctttctaactctgacctaatattttggagcatagaggaaagaaacatcttatgtttctgtgtttgggtaaacattagacttataaaagggcctagggtttttttgtttggtaaaccattgcctttcctgctttggtgtggcaaatcttcctttggagaaaaaggtccctttaatcttaaaaccaactctcagtgaccaacaaaagcaacaaataggaacaaccacccattaagaaccatcaggtgatgcctcatttgctgtggtgcacagctgaacttgattgttactcttggatcagggttggcttgataaggactcacttaaccaatggaaagtaaggttaaatctttgtaagcaatgctcctgatgcgaatcacctggagatcttgagcaaatgcagactggttcagcagatctggagtggggcctgagattctgcatttctaacaagtttcctggtgatattaatgctgctggtctgtgagccatactttgagtagcaaaggactaaaggttgtgagataaactgcttttagcagcccaaagggccagctggaaagacgagaccagttacagagcaaatggcaagacagatctggtaatctgattcttagagtacttaaaaaagataagaaggatctattcctgatatacagggtacttggtggatgtgtccatgacctcgagatcgaaaacccattagttaatctttgtgacatctgaattttaaggatcttacccagtgaacatataactagtggaaatcctgataattggctaatgcaaggaagtgatacccatgtgtaatgcttatctttgtatccatttcatggggaaggtcatggaagacgacagcaaacttgagtggttaatgagagcttcactaatgttgtctgctgcaggcaataagtgaagtctctggcagtgggaagcatggacccaagaccgaaagctctggcactttatagcagtggtggggggtagataggacttagtgtggccccttaaagagcaaggtccaagtgattttctctggtgaatgtcgatgtggatctagtctccagggttagatccaggcaggtaacatcaaagtcagttgataagacctcttatgcctgtgaatggaaggccctgataaaacttcattattaatgttctgcattaatttagcggatgactatagtcatttcacataatctaatacatgaatgtcctgtatgggtgactgctgagggtttaacaaaggagagtccatttatatttggctggtaagatcgatgcttctgtcactactgatgggcaaggatattaacatcaatatctaaaaaaattctgagatttggattgtgatgtgttaaatttctagaccaatttgaggagaatttaacaatagcttttcaatttatgaacatggcgtatatcttttttggcggggggtgaggacagagtcttgctctgagattacccaggctggagtttagtagcatgatcttggctcactgcaacctctgcctcctgagttgaagcaattctcctgcctcagcctccccagtagctgggattacaggcgagcgccatcatgcctgactaattttcgtatttttagcagagacagggtgtcgccacctcaagggatccacctgccttggcctcccaaagtgctgggatttataagcgtgagtcaccgtacctggccagacatagcatatatcttcctttacatagattgcctttgatttctttcattgttactttgtagttttcagcttacagattccgcgcatattttgttagacttaaatctaagtatttgctttttttttaacttacaaatttttttaaaaaaacgtttttcctctccaatgttcattgctaatacatttcacgtttgaatctccagttcagaaaaatcatggcctctggagttttactgaggactagagatagctaagtaacatagttccaccttattcacttggtctttgatgtggtgtccataattgagtaaatggcagtatgtccaatggcaacaccatgaacttgactttgccctcttgtctagccctctccatttagacttggaagggtcagcagtaaaatttcactggcccagtccagggctgcttgagtgttactgttttgtgccacaatatgatgtggccagactacttttctagtttcgagattattttggagctttatattgggtatgttcttatccaactatcattaggggcattgatctctgatgcccttttctttcttatcttccaaatggcaggcagtaaatggcttattaagcaagtataagattcaagatctcagccccaaagatacatttgtagatgccaggcttaacattcctgaggctctcagagaaaacttttccctctatagactccccattttaagaaggaggcacagggcttggttggcccatttagttagtgacacacctatattactctccttggcatcttaccccagcccatccattgggttgtgtcagtcttttatttctaagtgaggatccagtcaacaggaggcacaagagatagaaccaaataccataatgcctccttctattccactatgaacagtcaaggacactggaggcctctgggtgggacacataggcgttcaagagcctctgagcttaaagatatgtgagtggagctaactagactgtccaggtttggtctacactgtaattttttttttttttttttttttttggaagcagagtcttgctcttttgcccaggccagagtgtagtggtgtgatctcagctcagtgcagcgtctgcttcctgggttcaagtgattctcctgcctcagcctccaagtagctgggactacaggtgcctgccaccatgcccagctaatttttgtatttttagtagagacggggtttcaccgtgttggccaggctggtctcgaactcctgagctcaagtgatcctcctgccttggcctcccaaagtgttgggatagcaggcatgaaccaccgtgctcagcctctctgtaaatcttgagtcggcactgagctcatgaaagctgtgctgagtgggtttctttagattttcattttcatgtttgccccatttatgctaatattaattattggaaaataattcacctactttgcttctctctgaccaacataggggcaggatctgtggaaagacatttaccacctgtttgaaaaggtcagcgtgctgatattcactaactactacccccacaactccccctcccccaaacctgatagatgctataatttctgcagtccaatcactattcttcccaaactccatgagccagattttatacatactttgcgtgaccataaaactctgtactattatagacataaaaccatttaatttcatagataccttcagtggtggcatcactgggtcctctcttggatagcatagtcctatgaccaaatgggtcagtcgttgatcaggcttcatgagaatatgatcgctgggagaaatatacagctaatttaacaacaaatgactgtcctaattctggagacctgggaagtattgatgagagtatagtgatcataagcagacattgggtgctttagcaaagccaatttgcctgcatcctctggaaggtaaagaagatctcctctctcttagaacttaatcaaactcttggcatccacagaaggctaggaggatgtaatgaatacttaccatttttgtggaagcccacaaccttttgaatggcctttctatactttagtgaacctccatgttatgaaccttacttcctcaagtctcttttgctgctaggaggcagacagtaacttcggtaattagaaacatctgcactcagcaacatgaagcacaagttctgtgcagttgtccatatgctgtcatgagttttgccatatgtatcatctggctttcagaggacctttcatggttgtcaggttaagttcctgatacagaagtggcatcagtgctggtgttaatggctgcagtaaagtcaaattcctagattttagtgctctgtggtagcagagagaatggtggtagtttattttttctttccttttttttttaaaaaaaaaaaaaaacctttttcatgttgaagttcacatgacctacaactaaccattttaaagtgtaattcagtgtcattcagtacatccacaatgtgcaatcaccacctctgtctagttccaaaacatttttatcaccctaaaaggaaaccttgcacccattaaacagtggtagtttctctatcatgccacttttgtagcatgctttggggtcttattcctgggatctttctctacagtggtatgattatataagggtggaaatataaaagagtaagcctttagaaacagtttgtgtctaaattagctctcaggcatattgtcttcaaaggaatgttttaaaccagccaaagactaacatcaacatgcttacattttgagtccaaaattaaaatccaaaatagccaagcatggtggctcacgcctataatcccaactactccagaggctgaggtgtgatagaatttcttgaacctaggcgttccaggctgcagtgagctatgattgtgctgctgcactccagcctgggtgacagagcgaggttgcttctaaaacaaaaatttgaaatagtaagtgctttgattttttttaatatagaatcaaacaattgtgaaaatataattggctaagtttcatatacagttctttctaaaactccttctgttctctaagatgtagtttgaaccagccaaggatgatggcttcaacatgtctccagttgttttgccactccagggcctgactcaaaccaaaataagacttgctgttaccctgagacaagccaactgtcattgctttagcaaccactacggctacaggttgttgcatcatgccaagctctgtgttctttctaactagtagaatggagtgggatggtatcgtgatggtgaacccaaaacaatggtactaggaaggaggttggccaaactcagagtggaggctgaccctgtatctggttgtagcagagtcggtcctaggggaacaggctcagcagcagcaaggatgcaaggaccagaaggcagcaggggaaggaaaaggagcaggggataggggaactttaggagcagagtagtgttgataactggcatctggaacctacagtttccagttcagagcagtacaccatactcagtgtatacttacactccaagacatttcctgggcagtgatctagaaatgatatttttaaaaggagctgtgtttcagtgttagactgtagttatccaagcagtatcagatagtgtgcagtttttgtagtaaaaggtaaaaatctgaataataaagtttattaataacagttttagttaatacttgactgacattgagacccttgatgcaaaaaggtaagtagaagagaaggctgtaaacacaagaccatcataccctgtggggaatttacaatctaaatataacaaacatatagagtgagataggagaaaagaaatgggatgataatgatattgctgtactaaagtctatttaggaaatggaaatatatagcaagaggagtcagctacttgggcattgatcaaagaaaaataaacatatagaaggaaagaaaggtcgttttagtttataacattttccttccgattctaggtgattatatagctagtttactcttccacccccaagattctggggtattttggctaatgttatttgcaatgtccataaactcagaagaagttagtattaacggggatatgaaagaacctccagttactatgcaagaaattttaaatttccatcatgttaaattgtacaactgtttatcattcactctgctgtaagtctatgtgaaaccaaatccgtggatttaccaatggccattttatcacctccaaactatcttttatttttttgaattgtatctctctccttattccattttcttctgtttgattaaaatcctgcatgttctcctgca

SEQ ID NO: 172774 - DNA, 1515 bp, Homo sapiens
  Payload ID: 13962
  Gene Symbol: PDK1
  Gene Name: pyruvate dehydrogenase kinase, isozyme 1
  Uniprot ID: Q15118
  ENST ID: ENST00000392571
  CDS Start-End: 145-1515
gccgggctccggctaggagggtgggggccgcgccggtgacagccgatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgaaaggcctagaagaacatggttgcaggtctctagtttatgctgtatggcctgcaagatgatctttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctag

SEQ ID NO: 172775 - DNA, 2990 bp, Homo sapiens
  Payload ID: 13962
  Gene Symbol: PDK1
  Gene Name: pyruvate dehydrogenase kinase, isozyme 1
  Uniprot ID: Q15118
  ENST ID: ENST00000410055
  CDS Start-End: 101-1411
gatccccgcccctgctgcccgccacgtccctcacgtaccactcggcagaggcgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggatttgactgtgaagatgagtgaccgaggaggtggcgttcctttgaggaaaattgacagacttttcaactacatgtattcaactgcaccaagacctcgtgttgagacctcccgcgcagtgcctctggctggttttggttatggattgcccatatcacgtctttacgcacaatacttccaaggagacctgaagctgtattccctagagggttacgggacagatgcagttatctacattaaggctctgtcaacagactcaatagaaagactcccagtgtataacaaagctgcctggaagcattacaacaccaaccacgaggctgatgactggtgcgtccccagcagagaacccaaagacatgacgacgttccgcagtgcctagacacacttgggacatcggaaaatccaaatgtggcttttgtattaaatttggaagtgtggcccagagttgctcagaattggagcagagcctgagacgtatctgcagatcctgtcatcagctggcaagtccaggagactgtgtcatttagagactgtgttgttagttatccctcaacatcttctaaggtggcaggaaataatattggaaataacattttaaagtaaaaattttaaagtttaaagaagagttttgccacttaaacaggggagctttgtctggaaaatacactgagttgaaacacttcatccttggaaggattatataagatgaacagttgtgataaatgtgtagattagagggatgtgaatgggcagttagtccagtgccctcatttaagaggccaagatcctgattcagaggaggcatcctttgcccagagctgcttagctaatctgaccaaatgttgggaaaaatgtctcacctaacccactattccttaattatggattttgtgaaaaacaatagaacatgttaatgagtaatttatattagttcgatgtattacaattttttagctttaaattacagttttcttataatgttgaaatgttttagaatcctttgaatctaagtatttgtttcctaaatgaaacatttgtacaacatttgatgtttttacttatgaaatattctcctcccccaagaaaatttaaactttttctctctatttaaaagctaagaaatgttttaaaggaaaaatgaaattatcttcctttagcttatttttaaggtaaaacagctttttactctgttattgtggtaatggacagaatattacatacaaaaatattctgggagagctttttcctagttggttttaaatcattgtgccacctgaaaggtttttagattttataggagctaatttgtccaccagcattaatgtaacacagtgtagttatgaaaatatattgaaggacaggaagtggacacgaagtgatttttgtaacctgagcagttaatgaatgtgccaacattttctaggaagggacagcaagaatattctgctctgtagttaaaatactggctggcttttgatgtcttcatgcttaattgtgatcactttcttgcactgtgatgtttttacgtgaatatgttgaagtagaagtctaccatattattttataaaatgttttctgtatggcaataaactgaaaacatggatcaacccttcttttgaaaataaactgagtcaatttagccttttaaaaatatagtcatctcttttaaatagaatcctcttccaccatcaaggctcaacattttgtaagcatccaaaaaattggtaattagggggcttgcactaaatttcactatcttcagtagagaggaactgtttggaacttagatttccaatgtgtatattctaatggagaaagcaagaggtagagtttgtatgtttgacttaccttagatttttattttccatacatactgcaaatgattgacttgttgcataaatgaagatcttctgttgtgtgcttttcaaacactgtaaataaatttgaaatttgaataa

SEQ ID NO: 172776 - DNA, 558 bp, Homo sapiens
  Payload ID: 13962
  Gene Symbol: PDK1
  Gene Name: pyruvate dehydrogenase kinase, isozyme 1
  ENST ID: ENST00000439519
  CDS Start-End: 96-558
attgttgaaaacaaaccagctgggccgcgggacgacctcccgcctcccggcgcacgtgtgcaggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaag

SEQ ID NO: 172777 - DNA, 699 bp, Homo sapiens
  Payload ID: 13962
  Gene Symbol: PDK1
  Gene Name: pyruvate dehydrogenase kinase, isozyme 1
  ENST ID: ENST00000416991
  CDS Start-End: 13-699
tccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctgctttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgcaaaatcaccaggacagccaatacaagtggtttatgtaccatcccatctctatcacatggtgtttgaacttttcaagaatgcaatgagagccactatggaacaccatgccaacagaggtgtttacccccctattcaagttcatgtcacgctgggtaatgaggat

SEQ ID NO: 172778 - DNA, 842 bp, Homo sapiens
  Payload ID: 13962
  Gene Symbol: PDK1
  Gene Name: pyruvate dehydrogenase kinase, isozyme 1
  ENST ID: ENST00000443353
  CDS Start-End: 380-842
ataatatgctcctttttcaggtaaagagacggaggctcagagaggttaaacagctcactcaaaggcacagagccagtacatggcagtacatctcttctcccggggccgccgtcgcggtgatactatttagggccacacgtcccagtgttcagctttcgtatttacgtactactgtttggcaagcggggactcctgaagctctctgaccctggaaaatgcgtggcttgcgtcacagaggagcgtttctggaacgcgctcgcagcacgacaccgcggtgtgtgcaagcggaacgccgccctgtccttgagccttttggctgagattgggagggcagaggaagcaggaaggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcactctttattgtttggtggaaaaggcaaaggaagtccatctcatcgaaaacacattggaagcataaatccaaactgcaatgtacttgaagttattaaag

SEQ ID NO: 172779 - DNA, 571 bp, Homo sapiens
  Payload ID: 13962
  Gene Symbol: PDK1
  Gene Name: pyruvate dehydrogenase kinase, isozyme 1
  ENST ID: ENST00000436490
  CDS Start-End: 126-314
gctcgcagcacgacaccgcggtgtgtgcaagcggaacgccgccctgtccttgagccttttggctgagattgggagggcagaggaagcaggaaggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgaggaataggtccaaaacaggcaggctttattggctcattcatcttgattccttgcagagcagagcaggtgttctctagagctttacagatactgtgatacggatcagaaaccgacacaatgatgtcattcccacaatggcccagggtgtgattgaatacaaggagagctttggggtggatcctgtcaccagccagaatgttcagtactttttggatcgattctacatgagtcgcatttcaattagaatgttactcaatcagcact

SEQ ID NO: 172780 - DNA, 728 bp, Homo sapiens
  Payload ID: 13962
  Gene Symbol: PDK1
  Gene Name: pyruvate dehydrogenase kinase, isozyme 1
  ENST ID: ENST00000431718
  CDS Start-End: 50-544
cgcggggaaacctggcgtactggctgtggcttctctagcgggactcggcatgaggctggcgcggctgcttcgcggagccgccttggccggcccgggcccggggctgcgcgccgccggcttcagccgcagcttcagctcggactcgggctccagcccggcgtccgagcgcggcgttccgggccaggtggacttctacgcgcgcttctcgccgtccccgctctccatgaagcagttcctggacttcggatcagtgaatgcttgtgaaaagacctcatttatgtttctgcggcaagagttgcctgtcagactggcaaatataatgaaagaaataagtctccttccagataatcttctcaggacaccatccgttcaattggtacaaagctggtatatccagagtcttcaggagcttcttgattttaaggacaaaagtgctgaggatgctaaagctatttatgactttattgtttggtggaaaaggcaaaggaagtccatctcatcgaaaacacattggaagcataaatccaaactgcaatgtacttgaagttattaaagatggctatgaaaatgctaggcgtctgtgtgatttgtattatattaactctcccgaactagaacttgaagaactaaatgaatgcaatgagagccactatggaacaccatgccaacagaggtgtttacccccctattcaagttcatgtcacgctgggtaatgaggatttgactgt

SEQ ID NO: 172781 - DNA, 2384 bp, Homo sapiens
  Payload ID: 13963
  Gene Symbol: PDK2
  Gene Name: pyruvate dehydrogenase kinase, isozyme 2
  Uniprot ID: Q15119
  ENST ID: ENST00000007708
  CDS Start-End: 392-1423
cttttcctgagccgcttggatctttgtggaagcgggtgggctgcatatatacaggacggattcgtataggcttgcaccctggttccgaattttgcaaatattcgcagtctgggtcactgtcatccggactgggaatccccaagacccgttaagggaggatagaaggagctggaccctagctgccccagtgggcaaggacacttgaagatcaaatctgttccggcctggcagcctctccccagctgggcaggggccccaggcaccgtgatgtggagtcaagccgcctatacctcccttggctgccccagggctgctaggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacgacatggctaagctcctgtgtgacaagtattacatggcctcacctgacctggagatccaggagatcaatgcagccaactccaaacagccgattcacatggtctacgtcccctcccacctctaccacatgctctttgagctcttcaagaatgccatgagggcgactgtggaaagccatgagtccagcctcattctcccacccatcaaggtcatggtggccttgggtgaggaagatctgtccatcaagatgagtgaccgaggtgggggtgttcccttgaggaagattgagcgactcttcagctacatgtactccacagcacccaccccccagcctggcaccgggggaacgccgctggctggctttggttatgggctccccatttcccgcctctacgccaagtacttccagggagacctgcagctcttctccatggaaggctttgggaccgatgctgtcatctatctcaaggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatcctcctgggggagcagggggtgggttctccctgatgaccaggttctgtctctatggaagtcactgcggtgataggtctgtgatggtccctaagtgccagtccatctctgtggagacccctcggtggcctccctatctctgtgggcgatgcctgagggttagggatgtctccaccctgatggggtgtcccagagacattttcccatggcagtcctcctctctgagaccagggctgtcacttttctgccaggggtactgggtccccctcagcaccctccacagcacaggccttccaagtggatgtcccgttgccttattcccccagcccacaaaggcaccctggccttggcctgctgaagtgttaggaagagggtgggtgccctccagacctggggactgagtggggaaaggagttacacccgtgagtggggaatgaggctggtcctgcagcctctccctccgctcagggcttgaaggtcggtggcggagggggtggctctcacagggcccaactctaaagtggaagaaccttgttagaccgagagcttgccatccagccaagctgctcgaggccctgcagtggccttggcaatgtctgtgccacctcctgagccctcccagcatgtcctcacatgctcatgcccacccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgag

SEQ ID NO: 172782 - DNA, 3440 bp, Homo sapiens
  Payload ID: 13963
  Gene Symbol: PDK2
  Gene Name: pyruvate dehydrogenase kinase, isozyme 2
  Uniprot ID: Q15119
  ENST ID: ENST00000503176
  CDS Start-End: 162-1385
attggcgacgtcgaggcgccatgacgagccgattggctgggcgttggaatgcccgccagggcaagggtagggaggaggcggccgaaccgcgtcgctgggccgaaaggtgcgcgagcgctgcccgcgcggggaccacaaccaaagtcgcggccgccgcagccatgcgctgggtgtgggcgctgctgaagaatgcgtccctggcaggggcgcccaagtacatagagcacttcagcaagttctccccgtccccgctgtccatgaagcagtttctggacttcggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacgacatggctaagctcctgtgtgacaagtattacatggcctcacctgacctggagatccaggagatcaatgcagccaactccaaacagccgattcacatggtctacgtcccctcccacctctaccacatgctctttgagctcttcaagaatgccatgagggcgactgtggaaagccatgagtccagcctcattctcccacccatcaaggtcatggtggccttgggtgaggaagatctgtccatcaagatgagtgaccgaggtgggggtgttcccttgaggaagattgagcgactcttcagctacatgtactccacagcacccaccccccagcctggcaccgggggaacgccgctggctggctttggttatgggctccccatttcccgcctctacgccaagtacttccagggagacctgcagctcttctccatggaaggctttgggaccgatgctgtcatctatctcaaggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatcctcctgggggagcagggggtgggttctccctgatgaccaggttctgtctctatggaagtcactgcggtgataggtctgtgatggtccctaagtgccagtccatctctgtggagacccctcggtggcctccctatctctgtgggcgatgcctgagggttagggatgtctccaccctgatggggtgtcccagagacattttcccatggcagtcctcctctctgagaccagggctgtcacttttctgccaggggtactgggtccccctcagcaccctccacagcacaggccttccaagtggatgtcccgttgccttattcccccagcccacaaaggcaccctggccttggcctgctgaagtgttaggaagagggtgggtgccctccagacctggggactgagtggggaaaggagttacacccgtgagtggggaatgaggctggtcctgcagcctctccctccgctcagggcttgaaggtcggtggcggagggggtggctctcacagggcccaactctaaagtggaagaaccttgttagaccgagagcttgccatccagccaagctgctcgaggccctgcagtggccttggcaatgtctgtgccacctcctgagccctcccagcatgtcctcacatgctcatgcccacccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgagactggcctggctgcatccctgggggaggggacccacacgtgcgcacgtacacacgcacactgcggtgccctgtgaccaccacatgacgcaccggggacgtccggcccagctcaggactgtgagtaaaacactgggcaaagccatctgttcagaacgccggatggcccagcacctggtgacagacctgttgtcccaccatactcagggcccagcagagtccggccaacccaacaactggagcagacagaaattctggtcactggcacatcataaggatttattgaaataaattgagaactgcctccccttcacatgcaggtgggcacccactatagctactgatggctttaaggatgtgggtgccttccaacctcccatggccctgccaccaggcccagatggtgccagtgtcctcatatctgtttccctccgaagcccctctcccagcacagatagcagaggggggataagggctgagtcccaggtacagggtgctggccgtaagccacagcccctgggcaggaatgagggagccagcatgcattggtgccatctgccgctctgtctgggcagatgggaggagctggaggggtttccaagcgggagcccccaggcctcatcggtaactctgaccagtgtcctggaagcgggactagctgctgaccagcgccacacatgaacacttcctccaaggacatttcctaaaaaggacacatgctgtccccaggctgctggtaaactccacccccatccagggagctggccccagccctcagtgtggcccagggaagcagagcttgcaccgcctgccagttctgagcccactgattccctgacaatgcctggggcagatgggggagggctgatgaacctttccaatctcgtagctgccggggacccccaggttttgcctctctgcctggctggggtgagggctgaccaggtcagcagctcctaggccttggctggtggaagtggtgtcctctgtccctatcagttcctgtttgctcagctcccaaagaggacttaggtgccctctgaggaagcagcaggaagtgaagggagtcctggcttggagaatgggtcaaagacca

SEQ ID NO: 172783 - DNA, 590 bp, Homo sapiens
  Payload ID: 13963
  Gene Symbol: PDK2
  Gene Name: pyruvate dehydrogenase kinase, isozyme 2
  ENST ID: ENST00000512238
  CDS Start-End: 296-590
agaggtgcagccatctgtagagagacctggactgggcatgaagggtcagacacccctgggcagaggaaggagctggaccctagctgccccagtgggcaaggacacttgaagatcaaatctgttccggcctggcagcctctccccagctgggcaggggccccaggcaccgtgatgtggagtcaagccgcctatacctcccttggctgccccagggctgctaggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgca

SEQ ID NO: 172784 - DNA, 576 bp, Homo sapiens
  Payload ID: 13963
  Gene Symbol: PDK2
  Gene Name: pyruvate dehydrogenase kinase, isozyme 2
  ENST ID: ENST00000510219
  CDS Start-End: 96-576
cactgcaaccattgcctcccaggttcaagcgattctcctacctcagcctcccgagtagctgggattacaggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacgacatggctaagctcctgtgtgacaagtattacatggcctcacctgacctggagatccaggagatcaatgcagccaactccaaacagccgattcacatggtctacgtcccctcccacctctaccacatgctctttgagctcttcaagaatg

SEQ ID NO: 172785 - DNA, 947 bp, Homo sapiens
  Payload ID: 13963
  Gene Symbol: PDK2
  Gene Name: pyruvate dehydrogenase kinase, isozyme 2
  ENST ID: ENST00000503614
  CDS Start-End: 171-947
tcgaggcgccatgacgagccgattggctgggcgttggaatgcccgccagggcaagggtagggaggaggcggccgaaccgcgtcgctgggccgaaaggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacgacatggctaagctcctgtgtgacaagtattacatggcctcacctgacctggagatccaggagatcaatgcagccaactccaaacagccgattcacatggtctacgtcccctcccacctctaccacatgctctttgagctcttcaagaatgccatgagggcgactgtggaaagccatgagtccagcctcattctcccacccatcaaggtcatggtggccttgggtgaggaagatctgtccatcaagatgagtgaccgaggtgggggtgttcccttgaggaagattgagcgactcttcagctacatgtactccacagcacccaccccccagcctggcaccgggggaacgccgctg

SEQ ID NO: 172786 - DNA, 615 bp, Homo sapiens
  Payload ID: 13963
  Gene Symbol: PDK2
  Gene Name: pyruvate dehydrogenase kinase, isozyme 2
  ENST ID: ENST00000505440
  CDS Start-End: 191-615
taatggggaagcaggaaccggccggggcctctcgacggggctgctgatgggaatggggggcatttacaaggacggtcccgaggtttcttcgtgggcctcatgaagggtcttgaagagatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacga

SEQ ID NO: 172787 - DNA, 578 bp, Homo sapiens
  Payload ID: 13963
  Gene Symbol: PDK2
  Gene Name: pyruvate dehydrogenase kinase, isozyme 2
  ENST ID: ENST00000508030
  CDS Start-End: 190-578
tatacaggacggattcgtataggcttgcaccctggttccgaattttgcaaatattcgcagtctgggtcactgtcatccggactgggaatccccaagacccgttaagggaggataggatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaa

SEQ ID NO: 172788 - DNA, 2493 bp, Homo sapiens
  Payload ID: 13963
  Gene Symbol: PDK2
  Gene Name: pyruvate dehydrogenase kinase, isozyme 2
  Uniprot ID: Q15119
  ENST ID: ENST00000614357
  CDS Start-End: 191-1222
taatggggaagcaggaaccggccggggcctctcgacggggctgctgatgggaatggggggcatttacaaggacggtcccgaggtttcttcgtgggcctcatgaagggtcttgaagagatccagcaatgcctgtgagaaaacctccttcaccttcctcaggcaggagctgcctgtgcgcctggccaacatcatgaaagagatcaacctgcttcccgaccgagtgctgagcacaccctccgtgcagctggtgcagagctggtatgtccagagcctcctggacatcatggagttcctggacaaggatcccgaggaccatcgcaccctgagccagttcactgacgccctggtcaccatccggaaccggcacaacgacgtggtgcccaccatggcacaaggcgtgcttgagtacaaggacacctacggcgatgaccccgtctccaaccagaacatccagtacttcctggaccgcttctacctcagccgcatctccatccgcatgctcatcaaccagcacaccctcatctttgatggcagcaccaacccagcccatcccaaacacatcggcagcatcgaccccaactgcaacgtctctgaggtggtcaaagatgcctacgacatggctaagctcctgtgtgacaagtattacatggcctcacctgacctggagatccaggagatcaatgcagccaactccaaacagccgattcacatggtctacgtcccctcccacctctaccacatgctctttgagctcttcaagaatgccatgagggcgactgtggaaagccatgagtccagcctcattctcccacccatcaaggtcatggtggccttgggtgaggaagatctgtccatcaagatgagtgaccgaggtgggggtgttcccttgaggaagattgagcgactcttcagctacatgtactccacagcacccaccccccagcctggcaccgggggaacgccgctggctggctttggttatgggctccccatttcccgcctctacgccaagtacttccagggagacctgcagctcttctccatggaaggctttgggaccgatgctgtcatctatctcaaggccctgtccacggactcggtggagcgcctgcctgtctacaacaagtcagcctggcgccactaccagaccatccaggaggccggcgactggtgtgtgcccagcacggagcccaagaacacgtccacgtaccgcgtcagctaagggccgccgtgcatctgcacctgagaggacggactgccgcctctgggtccccccaccgtggtgcccctcaccatcctcctgggggagcagggggtgggttctccctgatgaccaggttctgtctctatggaagtcactgcggtgataggtctgtgatggtccctaagtgccagtccatctctgtggagacccctcggtggcctccctatctctgtgggcgatgcctgagggttagggatgtctccaccctgatggggtgtcccagagacattttcccatggcagtcctcctctctgagaccagggctgtcacttttctgccaggggtactgggtccccctcagcaccctccacagcacaggccttccaagtggatgtcccgttgccttattcccccagcccacaaaggcaccctggccttggcctgctgaagtgttaggaagagggtgggtgccctccagacctggggactgagtggggaaaggagttacacccgtgagtggggaatgaggctggtcctgcagcctctccctccgctcagggcttgaaggtcggtggcggagggggtggctctcacagggcccaactctaaagtggaagaaccttgttagaccgagagcttgccatccagccaagctgctcgaggccctgcagtggccttggcaatgtctgtgccacctcctgagccctcccagcatgtcctcacatgctcatgcccacccgctcctccacaagcctagtccatcctgcctgagctccagcccccagcccccactgtgcccagacatgtgtgctcagggtggctttctccctaggaccttctgtgtatatagttagttttataaccctgaatgcccccacccttcccctaagcacacaggggttaaagctgtgtgtccctcccagtggctgtggcagtgacagtgacacccacacccacagtaaagaggagactgaatgagactggcctggctgcatccctgggggaggggacccacacgtgcgcacgtacacacgcacactgcggtgccctgtgaccaccacatgacgcaccggggacgtccggcccagctcaggactgtgagtaaaacactgggcaaagccatctgttcagaacgccggatggcccagcacctggtgacagacctgttgtcccaccatactcagggcccagcagagtccggccaacccaacaactggagcagacagaaattctggtcactggcacatcataaggatttattgaaataaattgagaactgcctccccttc

SEQ ID NO: 172789 - DNA, 1809 bp, Homo sapiens
  Payload ID: 13964
  Gene Symbol: PDK3
  Gene Name: pyruvate dehydrogenase kinase, isozyme 3
  Uniprot ID: Q15120
  ENST ID: ENST00000379162
  CDS Start-End: 236-1456
gcgtacgtgcagcaaccgactccgcccagcgaggcggagcctagggaagccgcgggcggcccgccgctgtcctggagctgctgctgctgctgcggcggctgcaccggcggcgccgaggccgagatcgaggccggggtgcgcgcttcgcaaacgtgccctatccgtgcggcttggctgcgccagcccttgcggccacccgggcgtctaggcgggtctgtgcgccgcccgggcgaggatgcggctgttccggtggctgctgaagcagccggtgcccaagcagatcgagcgctactcgcgcttttcgccgtcgccgctctccatcaaacaattcctggacttcgggagagataatgcatgtgagaaaacttcatatatgtttctacgaaaggaacttcctgtgcggctggctaacacaatgagagaagttaatcttctgccggataatttacttaaccgcccttcagtgggattggttcagagttggtatatgcagagttttcttgaacttttagaatatgaaaataagagccctgaggatccacaggtcttggataactttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacacacttctgtttgggggtgacactaatcctgttcatcctaaacacataggaagtatcgatcccacctgtaacgtggcggatgtggtgaaagatgcatatgaaacagccaagatgctgtgtgaacagtattacctggtagctccagagctggaagttgaagaattcaatgccaaagcgccagacaaacctattcaggtggtttatgtgccctcacatctgtttcatatgctatttgagttgttcaagaactcaatgagagcgacagttgaactctatgaagacagaaaagagggctaccctgctgttaaaaccctcgttactttgggtaaagaagacttatccattaagatcagtgacctaggtggtggtgtcccacttcgaaaaatagatcgtctttttaactacatgtattctactgctcctagacccagcctggagcctaccagagctgcccctttggctggatttggttatggtttgccaatttcccgtctgtatgctagatattttcaaggagatctgaaactgtattccatggaaggagtgggtactgatgctgtcatttatttgaaggctctttcaagtgagtcatttgagagacttccagtttttaataagtccgcatggcgccattacaagaccacgcctgaagccgatgattggagcaatcccagcagtgaacccagggatgcttcaaaatacaaagcaaaacagtaatataccaccttgatttccattacaaagtatctgatttgtctgaataaaggtgtcccactcactgttccaggaattcttgcagtgtagaggtattcacaacagcaagcagggatttggcctgccatcaattttatttaaaaagcaattaagtttgcagtttgtcctcataaacgttgtaggttgaaactgaaaaataagttaaaatgatcaatcaagataaaaggtgatctatccatccaatggaatattatttggccttaaaaaggaaggacattctgatatgtgctgcaacatgggtgaatcttgaagtcattatgctaagtgaaataaaccagacataaaaggacaaatac

SEQ ID NO: 172790 - DNA, 1921 bp, Homo sapiens
  Payload ID: 13964
  Gene Symbol: PDK3
  Gene Name: pyruvate dehydrogenase kinase, isozyme 3
  Uniprot ID: Q15120
  ENST ID: ENST00000441463
  CDS Start-End: 1-1248
atgcggctgttccggtggctgctgaagcagccggtgcccaagcagatcgagcgctactcgcgcttttcgccgtcgccgctctccatcaaacaattcctggacttcgggagagataatgcatgtgagaaaacttcatatatgtttctacgaaaggaacttcctgtgcggctggctaacacaatgagagaagttaatcttctgccggataatttacttaaccgcccttcagtgggattggttcagagttggtatatgcagagttttcttgaacttttagaatatgaaaataagagccctgaggatccacaggtcttggataactttctacaagttctgattaaagtcagaaatagacacaatgatgtggttcctacaatggcacaaggagtgattgaatacaaggagaagtttgggtttgatcctttcattagcactaacatccaatattttctggatcggttttataccaaccgcatctctttccgcatgcttattaatcagcacacacttctgtttgggggtgacactaatcctgttcatcctaaacacataggaagtatcgatcccacctgtaacgtggcggatgtggtgaaagatgcatatgaaacagccaagatgctgtgtgaacagtattacctggtagctccagagctggaagttgaagaattcaatgccaaagcgccagacaaacctattcaggtggtttatgtgccctcacatctgtttcatatgctatttgagttgttcaagaactcaatgagagcgacagttgaactctatgaagacagaaaagagggctaccctgctgttaaaaccctcgttactttgggtaaagaagacttatccattaagatcagtgacctaggtggtggtgtcccacttcgaaaaatagatcgtctttttaactacatgtattctactgctcctagacccagcctggagcctaccagagctgcccctttggctggatttggttatggtttgccaatttcccgtctgtatgctagatattttcaaggagatctgaaactgtattccatggaaggagtgggtactgatgctgtcatttatttgaaggctctttcaagtgagtcatttgagagacttccagtttttaataagtccgcatggcgccattacaagaccacgcctgaagccgatgattggagcaatcccagcagtgaacccagggatgcttcaaaatacaaagcaaaacaagacaagatcaagactaatagaactttctagaggactgaatgctgtggtcctctctgtgaagaaagattgccttctgcaagtcaaacagagagaactgctttctcccacctgctctgagcgtggcatcacagttattcctagtgcttaaatgtgtattttctctctaccacctggactttcccaaagagtttttcctgtagctactccagatcttccactaaagtagtaactttttaatgacatcttgctgtggtgtgattgatgcctgtcaccgaagagcacagagcctccttacagctcttgtgccctcgtactctccatcttgttatcatagcatctgatgtcttcagtccttccaggattctgtgcgcctttcccattccagatacagcagatcgtactgttgctccttgtgaccaaataccatatttgtcccaaacctccacctagggccctgggaccctgaaagtggaagacatcaggtggccatgccctgatgatttagtcccagagccctccgtctctcccgtgcctccctccgccactctatgatttagacttttgccttcttccatctgatcggattctcattgtgagatgtggtgactttcatgttagatcttcttcattgatgccttggttttattttaaaattcatttgtatatgtctgttgattaaagcattcgaaatgttatcttagaa

SEQ ID NO: 172791 - DNA, 3576 bp, Homo sapiens
  Payload ID: 13965
  Gene Symbol: PDK4
  Gene Name: pyruvate dehydrogenase kinase, isozyme 4
  Uniprot ID: Q16654
  ENST ID: ENST00000005178
  CDS Start-End: 199-1434
actgcatctccgactctgcccagactcttcactccgcggcaccctcaaaccccagcccaggccggggcgcacaagccagccagcgcacctgcagtcctcgcccggacgcgccgcgccccctcggaaccaggctctgctccgagcagccttcgcccctcaagccagccacagtccccgccaggccgggtgggcgtcaagatgaaggcggcccgcttcgtgctgcgcagcgctggctcgctcaacggcgccggcctggtgccccgagaggtggagcatttctcgcgctacagcccgtccccgctgtccatgaagcagctactggactttggttcagaaaatgcatgtgaaagaacttcttttgcatttttgcgacaagaattgcctgtgagactcgccaacattctgaaggaaattgatatcctcccgacccaattagtaaatacctcttcagtgcaattggttaaaagctggtatatacagagcctgatggatttggtggaattccatgagaaaagcccagatgaccagaaagcattatcagactttgtagatacactcatcaaagttcgaaatagacaccataatgtagtccctacaatggcacaaggaatcatagagtataaagatgcctgtacagttgacccagtcaccaatcaaaatcttcaatatttcttggatcgattttacatgaaccgtatttctactcggatgctgatgaaccagcacattcttatatttagtgactcacagacaggaaacccaagccacattggaagcattgatcctaactgtgatgtggtagcagtggtccaagatgcctttgagtgttcaaggatgctctgtgatcagtattatttatcatctccagaattaaagcttacacaagtgaatggaaaatttccagaccaaccaattcacatcgtgtatgttccttctcacctccatcatatgctctttgaactatttaagaatgcaatgcgggcaacagttgaacaccaggaaaatcagccttcccttacaccaatagaggttattgttgtcttgggaaaagaagaccttaccattaagatttcagacagaggaggtggtgttcccctgagaattattgaccgcctctttagttatacatactccactgcaccaacgcctgtgatggataattcccggaatgctcctttggctggttttggttacggcttgccaatttctcgtctgtatgcaaagtactttcaaggagatctgaatctctactctttatcaggatatggaacagatgctatcatctacttaaaggctttgtcttctgagtctatagaaaaacttccagtttttaacaagtcagccttcaaacattatcagatgagctctgaggctgatgactggtgtatcccaagcagggaaccaaagaacctggcaaaagaagtggccatgtgaagagggacactcaggacactttacgggatcaaagtgggtctacaccagtgctgcttcctgaatgtttgtgtgtgaacccttgtttcctccaaaacaaacgacagcaacgaaaactccttaatcagaacactgatccaatgaggaatggagcttgtttctgtgacccaggagaacttagtgcaagactacaggagttaacagatggccagctccttattttttaatgtagaataactcctgagtttatatcaaatcctgaagaaataagcctcagttttccatctgtttttgataagaataagaaagggagtgagtgtgaagatggtggttagcagtttcactaagactgatattttaggcctcttgttcacatcaaaagatattggtgtcagaataccagcattttcctgccatgcaaaggattaaaacttagtttacactatgtggttacaaatatatgtcaatgtacattttgaacatatttatgtgctatggaaggaaatgctggtgactaaaataaggtttactctgaaagaggaggaattttattcaaagcattcaaacattttattcaagtgtttcaaaattcaaagcattgtattcaaagttgcagtgaaggcatcaacttatgtaaaaactcagaaggaaggctcctctgataaaaacacagctcctttattatgctgcttttcttgttcactttacacactaagtaaacacttattgtcaggtgcctagtcttgagtgaattgttagatgtgcactgaactcgggatgttggggattggagagagagaattgccaaagtaacagcaaaaatatctcttactttgctttgtttataaataaattagtagattggaaaaactagtgttagggaaagaaatcacatgttcagagcctaattcagtaggaagggcttttctctaccctgaaatgaaggtaatccaaaggcatccattttctaggcttaaaagatatatttttgatatatttaattatattctctacactccagcattaatatgtctgtttaaaaattactaattctcaaatggctcaagaacattagaatttaagtaccttttagagtaattattttaagcaaatagcctggacgtaagagattctcatgccagcatgctttcatttgtcagttgttgtgactgagagataatgaatgacacctgaaatgcatatggtatttttgggagagttaaggtataatttgaaggttggcagaccagttgcgctgattactcttagagaagaagaaatggaaaaatgaaagaaggcaggaaggaaagaaaggatataggaagagagggaagcagaaggcaggcatttttctattttccccacaaattatttcaaaaaaaatctgtattttctgggatatgtcattggcaagaggaagaactggtgttttgaaagcagtatggattctttaaatgcctctcactcttacaagatagtaggctttgagataataaacttacccgtgtcaattaacatttaaactggcatatagaaaaaaaggaggatttttctgcattgtaaaataatcagtatggtttatatgttgaatttgacatttgtgtgtaatttcatggtggcctagtgttgtggtgcttctggtaatggtaatagaagctcaactatttttttgtggatttcagtttttatcatcagaagtcctagacagtgacatttcttaatggtgggagtccagctcatgcatttctgattatacaaaacagtttgcagtaggttatttgtcatttcagttttttactgaaatttgagctaaacatttttacatgtaaatacttgtatttaccaaagatttaaatcagttgattaattaattaactcaaatactgtgaactatctctaaaacactagaaaaaagaaatgttagtatctcaattacaccaactgtgcaaatgaactttgataaaatagaaataatctacattggcctttgtgaaatctggggaagagctttaggattctagtagatggatactgaatactcaggcccacttaaattattaatgtatacattgtgtttttgtctttatgctatgtacagagaaatgtgataattttttataataaatattttttatgatgataaaa

SEQ ID NO: 172792 - DNA, 9255 bp, Homo sapiens
  Payload ID: 13966
  Gene Symbol: PDPR
  Gene Name: pyruvate dehydrogenase phosphatase regulatory subunit
  Uniprot ID: Q8NCN5
  ENST ID: ENST00000288050
  CDS Start-End: 958-3597
cagtgatgagttctagaaggaaagaaaaggctgatgtgacagtgaggaagggatgagtggagacttctctgagacttcagtgattcctcttcctctgagctgagccaagctgagaagctgagaagagtaagatagggccgggaactcaggtccgttagtccgtcctccgaggtggggcgggccagcagaatggatttccgatctactctgtgagagcctcgcccaagaaagcccagagccacttccaagatccgcgctcccacggcgatgagaagcgttttcccccgggactgcttggcttaggactggggacccactggctttggagtaagccctggcacgggcctcgagggaagaaagaactcccgcgctccccacactccacagggcctgcgatcatctcagatgttccggttccacgtgcagaaaccccgccggtccgaggccccggttctaaaacggccctaagagtcaaggcttccacagctcgcctctgagggtggcaaagaggccgcgggggcggtgcctcgcgagacccaaacaagcccacgtggcaggggcggggctccgcgaaggcgtcacggcgcgctcgtgcgctgctgaggtcacgcgccggcagtacccttgcccgggggccgtaaagcgcggaaggtcgcggtctcggcttccccggaactttttgctcgcttcgccccgcccccttcccatccccgaaccccgctttccggcccgcggcgaccccaggcaactgttgtggctgccgcattgctcccgccgggctgtagctgagcgcggagcccgtggggaccggtgagatggaactgttttcccgcgttgagacgtgcggtccgcttgtgcttttagaactaaagactgctgcagagtccggaggaagaagtcacctagaaaaatctgggacagggcatttgagttcctgagatctagttggtgagagacatgatgttctaccggttgctgtcgattgttggaagacaaagagccagcccaggatggcagaactggtcctctgcaagaaacagcacgtcagctgccgaggcgcgttccatggccctgcccacccaggcacaggtggtcatctgtggaggtggaatcacgggcacttctgtggcctatcacctctccaaaatggggtggaaggatattgtccttttggagcagggcaggctggctgctggctctaccaggttctgtgctggcatcctgagcactgccaggcacttgaccattgagcagaagatggcagactactcaaacaaactctactatcagttagagcaagaaacagggatccaaacaggttacacaaggacaggctcaatctttctggcccaaactcaggaccgactgatctccctgaagcgcatcaacgcagggctgaatgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatggtgttcagatctatgaccggacatctgttcttcatgtaatggtcaaaaaaggtcaagttactggagtggagaccgataaaggacagattgaatgccagtattttgtcaactgtgctggccagtgggcatacgagctgggtctgtccaacgaggagccggttagtatcccgctacatgcctgcgaacacttctacctcctgactcgccccttggagacccctctgcagagcagcacaccaactattgtggatgctgatggaagaatttatattcggaactggcagggtggcatcctgtctgggggctttgagaagaacccgaaaccaattttcactgagggcaagaaccagctggagattcagaatctacaggaagactgggatcactttgagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaccttgccgaatggatggtacatggttatccctcagaaaacgtttgggaattggacctgaaacgttttggagccctccagagcagccgcacctttctgcgccaccgggtcatggaagtcatgcctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaaggacctcctggcattggagcagagcaagactttctataagccagattggtttgacatcgtggagtctgaagtcaagtgctgtaaggaagctgtgtgtgtcattgacatgtcctctttcacaaagtttgagataacatccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacacatgccgaaagacagcaacctgctcctggaggacgtcacctggaagtacacagccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcctaaacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaatctaagatagaggtttggtcaacagtgcttaataataaataagaacctcctgccattctaattttcctgctgcaccccatcccccacacacccctcacgaacattgatataagcagtattaacacagtataaagaatgttcaccttgcatatgtcatttcaggcacatggattcaggagaagcacagttgagtggaagaaatggtagacttgtgaggcttgccccaggccttgtgtacacgcaataagtggtgagccatgggtctctccgtcagcgcctccctccccgccaccacttcaggccaacaatttaaggtgctgagttgtaaggctcctccattgtcagtacagggctcgcctttgtagccctgatcactaccagtacacttttcaagacaactgagtatttttgtatgcctttgccttccctttgtccatgaaacatgaagagttgtttatggttcttgacttctctgagcagagtgtctgcatctcttggagagttacacatttcttcatgagccatttttctcattcttagatgcacctgtttttatcctttgcagaccatcttctgccttcttattttcctgtctgtcaaagacagaaattacaggagatagggagggttttttagcatctctttcaaaagatgtatgtcagaatttcctttgcacaccaagaactggagcttagagccccactattctctaagccaggttctagtgccttacactccagaatgtcagatggtgggtgcagattggaagaaagagaaaagttcatctcggtgtgtgggttcccatccgccccacatagcctctccttcttcggaacaatgggcgtggggtagaaagctctttcagtgaagggtgttctagcagctcagttaacactttactctccagtcaacacttgggacatataaaaatgccattgtaactactgtagagtcctgtgactcatcgtttgtgtttgtcaatttgcagttcagcttagcccttccctgttcctgtgtagttacaatctggccctgaagacatccgaggcacttcagtaagtgggatcttttctagagatcctgggtgactttgggtgcacagggtgaccgagcatttctgcccctgtgaatgtggcactaacactgtgcactgtctccaccaagcaaggtttccactgagtttcttctcatgttactgggtttgtaaatgaataaacacattttaactactcttgca

SEQ ID NO: 172793 - DNA, 2734 bp, Homo sapiens
  Payload ID: 13966
  Gene Symbol: PDPR
  Gene Name: pyruvate dehydrogenase phosphatase regulatory subunit
  ENST ID: ENST00000398122
  CDS Start-End: 143-2482
aactgttgtggctgccgcattgctcccgccgggctgtagctgagcgcggagcccgtggggaccggtgaggctggctgctggctctaccaggttctgtgctggcatcctgagcactgccaggcacttgaccattgagcagaagatggcagactactcaaacaaactctactatcagttagagcaagaaacagggatccaaacaggttacacaaggacaggctcaatctttctggcccaaactcaggaccgactgatctccctgaagcgcatcaacgcagggctgaatgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatggtgttcagatctatgaccggacatctgttcttcatgtaatggtcaaaaaaggtcaagttactggagtggagaccgataaaggacagattgaatgccagtattttgtcaactgtgctggccagtgggcatacgagctgggtctgtccaacgaggagccggttagtatcccgctacatgcctgcgaacacttctacctcctgactcgccccttggagacccctctgcagagcagcacaccaactattgtggatgctgatggaagaatttatattcggaactggcagggtggcatcctgtctgggggctttgagaagaacccgaaaccaattttcactgagggcaagaaccagctggagattcagaatctacaggaagactgggatcactttgagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaccttgccgaatggatggtacatggttatccctcagaaaacgtttgggaattggacctgaaacgttttggagccctccagagcagccgcacctttctgcgccaccgggtcatggaagtcatgcctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaaggacctcctggcattggagcagagcaagactttctataagccagattggtttgacatcgtggagtctgaagtcaagtgctgtaaggaagctgtgtgtgtcattgacatgtcctctttcacaaagtttgagataacatccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacacatgccgaaagacagcaacctgctcctggaggacgtcacctggaagtacacagccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgt

SEQ ID NO: 172794 - DNA, 4353 bp, Homo sapiens
  Payload ID: 13966
  Gene Symbol: PDPR
  Gene Name: pyruvate dehydrogenase phosphatase regulatory subunit
  ENST ID: ENST00000565186
  CDS Start-End: 363-1838
ggtctcgaacccctgacctcgttatccactcgccgcggcctcccaaagtgctgggattacaggtgtgagccactgcgcccagcctaagtttttgaatttttagtagagacggggtttcactgtgttagccaggatggtctcgatctcctgacctcgtgatccgcccgccttggcctcccagagtgctgggattacaggtgtgaggcaccatgcccagccaccctcaaatatttgctgaatgaatggctatcgttctttgtcaaatccctttctcattaatcccatgcactgagtagaatggcatgaaatatgtttggtttctctgtctagtttgagttcctgagatctagttggtgagagacatgatgttctaccggttgctgtcgattgttggaagacaaagagccagcccaggatggcagaactggtcctctgcaagaaacagcacgtcagctgccgaggcgcgttccatggccctgcccacccaggcacaggtggtcatctgtggaggtggaatcacgggcacttctgtggcctatcacctctccaaaatggggtggaaggatattgtccttttggagcagggcaggctggctgctggctctaccaggttctgtgctggcatcctgagcactgccaggcacttgaccattgagcagaagatggcagactactcaaacaaactctactatcagttagagcaagaaacagggatccaaacaggttacacaaggacaggctcaatctttctggcccaaactcaggaccgactgatctccctgaagcgcatcaacgcagggctgaatgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatggtgttcagatctatgaccggacatctgttcttcatgtaatggtcaaaaaaggtcaagttactggagtggagaccgataaaggacagattgaatgccagtattttgtcaactgtgctggccagtgggcatacgagctgggtctgtccaacgaggagccggttagtatcccgctacatgcctgcgaacacttctacctcctgactcgccccttggagacccctctgcagagcagcacaccaactattgtggatgctgatggaagaatttatattcggaactggcagggtggcatcctgtctgggggctttgagaagaacccgaaaccaattttcactgagggcaagaaccagctggagattcagaatctacaggaagactgggatcactttgagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaccttgccgaatggatggtacatggttatccctcagaaaacgtttgggaattggacctgaaacgttttggagccctccagagcagccgcacctttctgcgccaccgggtcatggaagtcatgcctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaagggctagaatgtgttcacagaagaaaaagaaccacgtggactacactaaactctacagggccttgtgatttttccattccgtagacctcctggcattggagcagagcaagactttctataagccagattggtttgacatcgtggagtctgaagtcaagtgctgtaaggaagctgtgtgtgtcattgacatgtcctctttcacaaagtttgagataacatccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacacatgccgaaagacagcaacctgctcctggaggacgtcacctggaagtacacagccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaa

SEQ ID NO: 172795 - DNA, 2381 bp, Homo sapiens
  Payload ID: 13966
  Gene Symbol: PDPR
  Gene Name: pyruvate dehydrogenase phosphatase regulatory subunit
  ENST ID: ENST00000564563
  CDS Start-End: 99-212
aaagtctgtatactttttggttgggcagatctccaccggccctcaatctgattggccctcgagctgtggatgtgctgtctgagttgtcctatgcccctatgactccagaccacttcccaagcctcttttgcaagtggcaaccacagctgagtgaaacaaactgtaaccgaatgaaagcaatgacaacggaatcctccccaggaagctgctgattagagagggccaaacggacagacatcttggccacctgtaacgagcaacttccaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagac

SEQ ID NO: 172796 - DNA, 1207 bp, Homo sapiens
  Payload ID: 13966
  Gene Symbol: PDPR
  Gene Name: pyruvate dehydrogenase phosphatase regulatory subunit
  ENST ID: ENST00000567046
  CDS Start-End: 139-852
attaggatatgtttgaagtggatttagcttctctgaatttaaagtctgtatactttttggttgggcagatctccaccggccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagcc

SEQ ID NO: 172797 - DNA, 690 bp, Homo sapiens
  Payload ID: 13966
  Gene Symbol: PDPR
  Gene Name: pyruvate dehydrogenase phosphatase regulatory subunit
  ENST ID: ENST00000567896
  CDS Start-End: 390-690
atactttttggttgggcagatctccaccgggtactgatttggggttggggcttcttccatcacatagccttgctgggaaaaggaggagaacgggaattgtgtggggtggttatggccagccctgctgcgttcagcaggccctgttggcagaggtgtattcgccagaatcggggtgcttagcatccatccttggagtgtctaagcaaagggacatattcctggtctctgcacccaggcctggctatagctgagcaagtctacagtagacctttcccattggctcagctgttcagaaggagagctggacatctcttgttcttttccatttagccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaat

SEQ ID NO: 172798 - DNA, 598 bp, Homo sapiens
  Payload ID: 13966
  Gene Symbol: PDPR
  Gene Name: pyruvate dehydrogenase phosphatase regulatory subunit
  ENST ID: ENST00000569042
  CDS Start-End: 7-598
agaataatgctttccttatctaccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgg

SEQ ID NO: 172799 - DNA, 7223 bp, Homo sapiens
  Payload ID: 13966
  Gene Symbol: PDPR
  Gene Name: pyruvate dehydrogenase phosphatase regulatory subunit
  Uniprot ID: Q8NCN5
  ENST ID: ENST00000568530
  CDS Start-End: 163-2802
aactgttgtggctgccgcattgctcccgccgggctgtagctgagcgcggagcccgtggggaccggtgagaactaaagactgctgcagagtccggaggaagaagtcacctagaaaaatctgggacagggcatttgagttcctgagatctagttggtgagagacatgatgttctaccggttgctgtcgattgttggaagacaaagagccagcccaggatggcagaactggtcctctgcaagaaacagcacgtcagctgccgaggcgcgttccatggccctgcccacccaggcacaggtggtcatctgtggaggtggaatcacgggcacttctgtggcctatcacctctccaaaatggggtggaaggatattgtccttttggagcagggcaggctggctgctggctctaccaggttctgtgctggcatcctgagcactgccaggcacttgaccattgagcagaagatggcagactactcaaacaaactctactatcagttagagcaagaaacagggatccaaacaggttacacaaggacaggctcaatctttctggcccaaactcaggaccgactgatctccctgaagcgcatcaacgcagggctgaatgttataggtatcccttctgagatcatctcccccaagaaagtggccgagcttcaccatctcctcaacgtgcacgacctggtgggggccatgcatgttcccgaggatgcagtggtgtcttccgctgacgtggctcttgccctggcaagtgctgcctcccaaaatggtgttcagatctatgaccggacatctgttcttcatgtaatggtcaaaaaaggtcaagttactggagtggagaccgataaaggacagattgaatgccagtattttgtcaactgtgctggccagtgggcatacgagctgggtctgtccaacgaggagccggttagtatcccgctacatgcctgcgaacacttctacctcctgactcgccccttggagacccctctgcagagcagcacaccaactattgtggatgctgatggaagaatttatattcggaactggcagggtggcatcctgtctgggggctttgagaagaacccgaaaccaattttcactgagggcaagaaccagctggagattcagaatctacaggaagactgggatcactttgagcctctgttgagttcccttctgaggaggatgccagaattagagactctggagatcatgaagttggtgaactgcccagagaccttcacaccagacatgaggtgcatcatgggcgagtctcctgcagtgcagggctactttgtcctggcaggaatgaactctgctggcctttcatttggtggaggagccggaaagtaccttgccgaatggatggtacatggttatccctcagaaaacgtttgggaattggacctgaaacgttttggagccctccagagcagccgcacctttctgcgccaccgggtcatggaagtcatgcctttgatgtatgatctgaaggttccccgctgggacttccagaccggtaggcagttacgcacctctcctctctacgaccggctggatgcacagggagccaggtggatggagaaacatggatttgagaggccaaagtactttgttccccccgacaaggacctcctggcattggagcagagcaagactttctataagccagattggtttgacatcgtggagtctgaagtcaagtgctgtaaggaagctgtgtgtgtcattgacatgtcctctttcacaaagtttgagataacatccactggggatcaggcattagaagttctacagtacctcttctccaatgacctggatgtgcctgtgggccacattgtgcatactggcatgctcaacgagggtggagggtatgaaaatgactgcagcatagcacgactgaacaagcgcagtttcttcatgatctctccaaccgaccagcaggtccactgttgggcctggcttaagaaacacatgccgaaagacagcaacctgctcctggaggacgtcacctggaagtacacagccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaatgggcagtatgttggcaagaccaccagcagtgcctacagctacagcctggagcgccacgtttgcctgggctttgtgcacaatttttctgaggacacgggggaagagcaagtggtgacagcagatttcatcaaccggggagagtatgagattgacatcgcgggataccgcttccaggccaaggccaagctctaccctgtcgcctccctcttcacccagaagcgccgaaaggatgacatggagctgagtgacttacatgggaagtgatgccaccagggcagcctcacctcctccccatcatcttgtcctagagtgggcgtcaccttggagcttctcttccttccgcctctgttcctcttctggagcctttgcctcccatctcttatctccttgatataattttgaacttgacctactttaaacttttttgctctgcagccttccttgcccttccacctcctcctcctaatattcactctgggctcttcttcccttcccacccctcactcagcttctcgtggtggcaggaggtatgtctgacaggacagaagcaagctccactgtggacatgagtgatggtgacagctgctttcaaattctgcatctcaaggcagggcaagccggggtggtgcaggtctcagggcacgagtccctctcccttgggttccattttcttggagcagcctattagttctggtggggttgccgtgtgtcggatgcagccctgaggggcagctcgtgcctgcagcccggcagctcgttctcctgttctgctgtgctgtgggctggcactcgatacctctggcaagaggatgattatctacctcactgataagaggcatcgcatggacgttctctggtctgtagtggagacaagcagttaacctagcaccatcctcatcctccctgcagaagccattagcagacctttgggccagggcagcctccctataattttcttcatctcttgctaatctctataataaggttgctttttctttcttagttgagtaaacaagtaagccacagtgtttgaaagggaaaaaccatattgccttgtgtgttgcttttcccagtcaaaagggtctgaccttagaaagtccccaccagtgatgctgagtgttctgctatggaaacaatgctgcttttctctcagctgtccaaagttcagccgttcctccttccccttctcccagtgcgtttgactttgtcaggtcagcctcacttgtccctttcacagttggcccataaagtcatgtttctctccctttagaatagggaggggaagggatcaggtgtgttgtcctgggcctttcaaccttgcgggctgtgctgagttccagagagctgccggaattccaggtttgactctccagcacagagcagagctacacagaggtgacccacgttagtccactgagagttctgagtccaaagggtgtacgttgcataaggctagagaccgcttttcctcctttccccccaggctctttgtttccctccacccacccttccatatcctctggagcaggagacaatgtgggtgcccagaagtgccctgcgctttcaggcagtgtctctgttttcccaaggtgaaacttagatatcatggactgttgtccagcctcaatgcttcattttccccttgcatatcaactgccctaatctgactttttttaagtgcaaataaactgctataagacattttggttagtaaaactctagcctttggcgtgttggtatcttggaagcattagctctgataggtctataagtgtattaagggacatccttccatttcattagagcagcttaaaatgctcaggtgtctgccttctctggtgtttctttgggatctctgtttacccacttacgctggctccttctagacatttcttgccacttccccaactagaccactcctagtgattactgactttagtgcctaaacctttttggaaggttctggttggcttgttagaggagcatatgattagaattctgtttgggggtctagttgtcttggagcaagtatgtacttaactagccgagagatgctgcctctaggcagagaggaggagaggtgttgccggctggagggccaaccagtgaacaccagctgtgaaggccttgggagaggaggaacaggcccttgggcagatgcaggcattaccagcagggagcagacttacctccgaagatggagacaggtgactgagagctgcaggcctcctctgctcttccaaacacgtagcatttgcacccctccaaagccatctttgtaaaggaaaacgtatttgtaattgaatccagaagaatttagttacacatagacataactcttcaaccttaactatggcaatacatttgtgctttaactgttacatagcagtatcaccacttaccaggatccaaatcgaaataataaaagctgtctccatagtttaaaatcgaatagtgccatcatcacagtatattagtcaaatagaagcttcatcagaaatgtatcccacatagagttttaagacttggattctcttctgcccttgttaatctccaactaattactacagattgacacgtttttaattagctgtcctttgtaagaagtcaggaaatctgatgctgtgtccaaaattatgcactgtttgttgaagtagaaccagaaatcctgacctcctgttaaatgacatcagtttccccctctgagcaacagactgcttgtcttgctaggagaggaggatggggggctgagcactcaggctgtccattgaaaccccttgtccatgaatagggtcatactcctaagactgatggggtgttgatcttctaggacatcacttgtttattcagtgccccaaacacagatttctcttctagcactttagagttgatccttgaagtctctcctggttcattcaaatacaagctgtgtgagtctggtggttttctgtgattggtctaatgtgagctctttgaacagacagatctgacagtgaatgactctcccctgcttctggcataactgctttgcctctgtctagtgtccaagcatcttagctgttcaagaggagagggcagcataacttcctgaccaccggtgtcagatatcagagcattctggactcctgagaggcagtggcctcttgagtgaacaggggaggccagtagatgccccagatccagagccgtggctgcaaatccagcaggaataaggagggacaaccacagcctcctcatccatgtgtcatttccaagggtttgccttgtgtctcagctcattctgggcagcacgtttgtcttctgtccctagagatttgaaggattttggactcttgtgaatgggtgactggacttggctttacagagttgggtgcttttttctctctgcaattacctgtcatagcattttgtgctcaccacgaaggatggtctctgccttctcttgtcggtgtatgccatctgaacctaggaacacaaagtatattggcctcaaacggagacccagggttgccagttttccgtgggccttcccctcccttgaaatgtctttaattacctccccttcatcgtcaggccacgtgtgacttctgttcttagcactgccagggtcattgacttccatctaagcttgcatcaggaagatgttccttctgtgatcattggtactgaagccagaaaagctctcattcaggaactctgaagagcaaaaagggacaaacactaactgctgagctgggccatttgatctcctttcaccttgcattgctgtcacagcaccttgtatgatggcaggacaggctccagcagagagaactgcacagtgaccactgtatttttcacgctcttccagggatccctgtcccccgacattgaagagatctcattcaggccagagacacagagaccacatagcccagtgattaaaccccggtttcactctggccccaggagtggagcctggccactcctgtttggttctcactgggaggcccactggccttggatcatctcctcatgcacacccggagttttacctgcttgcttgctttcctggactgctgtttgcaagaaagtaactaaaacatgaaaagtaaacctccagcttccacagtatattacctgccgttgcatgcatttgaaagttagcctcctcccttgccaccgtcttggtggcagtagcgatgcaagaatgatgggagctttccgagagcgttcagtgtttcactgaagacaggacccatagccttcatttctggctctgtgtctcctctggcatatggacacatttcctggcatttgcctgagtctacaccactttttgagaacctgaaatagaagggaatcttctgtggcccacagtctccatattggcactagaagactggcctggcggaggaatttgcgttggcttgctttcaggggttagctacaagattcagctttatatctctgttgcttcttggccagtgtagtcaataagggtcttctttaacatctaagatagaggtttggttggccgggcgtggtcgcttactcctgtaatcccagcactttgggaggcccagtgaggtgggagaattgcttgaacccaggaggcagaggttgcagtgagctgagattgcaccactgcactccagcctgggtaacagagtgagactcttgtctcaaaaaaaaaaaaaaaaaaa

SEQ ID NO: 172800 - DNA, 551 bp, Homo sapiens
  Payload ID: 13966
  Gene Symbol: PDPR
  Gene Name: pyruvate dehydrogenase phosphatase regulatory subunit
  ENST ID: ENST00000563930
  CDS Start-End: 103-551
attaggatatgtttgaagtggatttagcttctctgaatttaaaccctcaatctgattggccctcgagctgtggatgtgctgtctgagttgtcctatgcccctatgactccagaccacttcccaagcctcttttgcaaggagatgagtgtgggctatgcaaatgggatccgggtgatgagcatgacgcacacaggagagccaggattcatgctctacatccccatagagtacgccctgcatgtatacaatgaagtgatgagtgttggccagaaatacggaatccggaatgctgggtattacgctcttcgcagtctccgaattgagaagttttttgccttctggggtcaggatataaataacctcaccacgcccctggaatgtggacgagagtctcgggtgaaattagagaagggcatggatttcattggtcgcgacgccctcctgcagcagaagcagaatggagtgtataaacgcctcaccatgttcatcctggacgaccatgattcagacctagacctttggccttggtggggagagcccatttaccggaa

SEQ ID NO: 172801 - DNA, 4272 bp, Homo sapiens
  Payload ID: 13967
  Gene Symbol: PDP1
  Gene Name: pyruvate dehyrogenase phosphatase catalytic subunit 1
  Uniprot ID: Q9P0J1
  ENST ID: ENST00000297598
  CDS Start-End: 270-1883
actcgtcactgcgcagccaatcggcaggcgggaagcactccggcccgaacgtgcgggcggggcagggtggcggccccgcacggtaggggagcagagtgggcaggccgggggtgagggctcgcgctccgggagctgcacggggctgcgtggaaagagcgccgagcggtggcgtcgttgtcgccccctcctcgtcgggaagaatcgtttggtctcctgccgtgcccggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgcaggttgtgcttgttcccaggcagtcagtgaaagactcttttattatattgctgtctctttgttaccccatgagactttgctagagattgaaaatgcagtggagagcggccgggcactgctacccattctccagtggcacaagcaccccaatgattactttagtaaggaggcatccaaattgtactttaacagcttgaggacttactggcaagagcttatagacctcaacactggtgagtcgactgatattgatgttaaggaggctctaattaatgccttcaagaggcttgataatgacatctccttggaggcgcaagttggtgatcctaattcttttctcaactacctggtgcttcgagtggcattttctggagccactgcttgtgtggcccatgtggatggtgttgaccttcatgtggccaatactggcgatagcagagccatgctgggtgtgcaggaagaggacggctcatggtcagcagtcacgctgtctaatgaccacaatgctcaaaatgaaagagaactagaacggctgaaattggaacatccaaagagtgaggccaagagtgtcgtgaaacaggatcggctgcttggcttgctgatgccatttagggcatttggagatgtaaagttcaaatggagcattgaccttcaaaagagagtgatagaatctggcccagaccagttgaatgacaatgaatataccaagtttattcctcctaattatcacacacctccttatctcactgctgagccagaggtaacttaccaccgattaaggccacaggataagtttctggtgttggctactgatgggttgtgggagactatgcataggcaggatgtggttaggattgtgggtgagtacctaactggcatgcatcaccaacagccaatagctgttggtggctacaaggtgactctgggacagatgcatggccttttaacagaaaggagaaccaaaatgtcctcggtatttgaggatcagaacgcagcaacccatctcattcgccacgctgtgggcaacaacgagtttgggactgttgatcatgagcgcctctctaaaatgcttagtcttcctgaagagcttgctcgaatgtacagagatgacattacaatcattgtagttcagttcaattctcatgttgtaggggcgtatcaaaaccaagaatagtgagtggctctttcactggcaattctcaaatgatatacatttaaagggcagattttttaaaaagatactactataataaacatttccagttggtcattctaagcatttacccttttgatactctagctagtcaggtactccaaattgactttgcagcagggtggcagggtcaggagagtctggtcctgcctagctcagatttcatggcacctgcacttgaagcaagtcacttctttatcacaggtgtcttgaaacattagcttcttttaccaacctgagaaaattaggatgacctggcaaataagatcttgaataggccaaaagcaagtatcttgctgtgtgtagtctcttggttaaagtgaagaaacagtactgttcacacctttcttcactgagattccagtgtacatgagaacatatatttattgcatgattttctagatacacagtctatgcattattcatatacatttattttagcctaaagtggttttcaaatccagttcttcaagccataaatgaccaagatccaagcaatctgaatttgtttttgtgattatttgactggaatgcttcttaagtggaataactatactccgttatccacccgatttcctaatgtaattgaaagattttctattttgccacacacttggagacaataagggtttttagttttatctactcttctattgaagttaaagaaagaaaaaaagatttttttatttgtattaatgaaaagctttagtttaaaataaggagatccagaataaaaagaagagactgatctcttcaattattgtcatctgtagccaccagcacatcactcttatgtaatccccaaaggcttggcatgccgtaagtgtgtggtgggtagactgctgccggggaatcgtacttcttatttagtaatgataagacttttcattatttttggaattttaaagatgacataaataagtttaaatatcaatttggggagtaaggtttaatattgccatcgggtattgagacaggaggaagtttctgtttttctccatttagacataggtcaattaaaatatttgggtttaaaatgactaaatgctttaaacatattgtagcttaagatatatgtgttaagatatatacatgagaaactttaaaaggtaactactgtgcatgcctgatgcttaatagaatacttagtggcatcaaatgtttgcagcagtctccataattatattcagtcccttctaatactgtatcaatgtaaatgaaataaatatattcaaattggctttttgatatgcatcaagtggcattttgttcctgtgtttaatagtgatctgtatacagctgtgcacatattgtcatcacttattctagcatcactgttaaggctgtgattatgtttgatattcacctggattttaatacaagccaatatcagcttcccattgtgtaataacttgggtgtttaggagtcttttcacattttttggggatatgaactagatgttcaagaactccttctggactgtggatactgaatcagtgtactattggctgcagaatttgtttcaattgaaaatagactcaggaagattgctgctcagaatatcatataatgtttattttttgaggtgtttttgtttttatttgtgtgtttttttttttttaagtcagcttggaacttttttcctgggtagtatttgggagagggaaaggctgtactatatatttatttctaaatgttttgactgggcatttttcttttaatgaaatatgtggactgctctagcaaaccctattttcagctactatttgaatattcttgaacaccaccactgaagagtttcatatacaccaaataatgtctcatctctatagtacagggaatataaaattggtttcctgtggtcatgatcaagatagtagtattattacacaagaaacttggtctgcagtctggaagcttgtctgctctatagaaatgaaaatgcagcatgaagttgacattgtggaaatgaaagtaattgggtattagaaatctgaaagtactgtcatctaaaagcaattgtgattttattgtaattggttgtcactgttgtacggtgtctagaattaaagaatacatgtaaactttcatggtatttagcctttcttaaatttttttaaaatttaaactttctaacctatgtattcaacttctgtatttatatttaatcagtggttcatgttatataatacacccttaactagttaaatggaatgttggtatggtacagagtaccatattgctaagaaaactgtcttataaaagatgtatatgtgtgaagacatgaaagtttaatgtacagaatggttggagaaatgcctatggtgaattaaagcttcatatctgctt

SEQ ID NO: 172802 - DNA, 4358 bp, Homo sapiens
  Payload ID: 13967
  Gene Symbol: PDP1
  Gene Name: pyruvate dehyrogenase phosphatase catalytic subunit 1
  Uniprot ID: Q9P0J1
  ENST ID: ENST00000396200
  CDS Start-End: 277-1965
agagtgggcaggccgggggtgagggctcgcgctccgggagctgcacggggctgcgtggaaagagcgccgagcggtggcgtcgttgtcgccccctcctcgtcgggaagaatcgtttggtctcctgccgtgcccggttcgtattccctactccctgccacgagccgccccgtccgggatcctccacccgtccaaagttgtgagggggcgccgggcgtgctcgcggatcggcggccgcgggcgtgcggagggctggacgagccctggagcgccaggagaatgtgtgtgtgtcccgggcccagacgaattggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgcaggttgtgcttgttcccaggcagtcagtgaaagactcttttattatattgctgtctctttgttaccccatgagactttgctagagattgaaaatgcagtggagagcggccgggcactgctacccattctccagtggcacaagcaccccaatgattactttagtaaggaggcatccaaattgtactttaacagcttgaggacttactggcaagagcttatagacctcaacactggtgagtcgactgatattgatgttaaggaggctctaattaatgccttcaagaggcttgataatgacatctccttggaggcgcaagttggtgatcctaattcttttctcaactacctggtgcttcgagtggcattttctggagccactgcttgtgtggcccatgtggatggtgttgaccttcatgtggccaatactggcgatagcagagccatgctgggtgtgcaggaagaggacggctcatggtcagcagtcacgctgtctaatgaccacaatgctcaaaatgaaagagaactagaacggctgaaattggaacatccaaagagtgaggccaagagtgtcgtgaaacaggatcggctgcttggcttgctgatgccatttagggcatttggagatgtaaagttcaaatggagcattgaccttcaaaagagagtgatagaatctggcccagaccagttgaatgacaatgaatataccaagtttattcctcctaattatcacacacctccttatctcactgctgagccagaggtaacttaccaccgattaaggccacaggataagtttctggtgttggctactgatgggttgtgggagactatgcataggcaggatgtggttaggattgtgggtgagtacctaactggcatgcatcaccaacagccaatagctgttggtggctacaaggtgactctgggacagatgcatggccttttaacagaaaggagaaccaaaatgtcctcggtatttgaggatcagaacgcagcaacccatctcattcgccacgctgtgggcaacaacgagtttgggactgttgatcatgagcgcctctctaaaatgcttagtcttcctgaagagcttgctcgaatgtacagagatgacattacaatcattgtagttcagttcaattctcatgttgtaggggcgtatcaaaaccaagaatagtgagtggctctttcactggcaattctcaaatgatatacatttaaagggcagattttttaaaaagatactactataataaacatttccagttggtcattctaagcatttacccttttgatactctagctagtcaggtactccaaattgactttgcagcagggtggcagggtcaggagagtctggtcctgcctagctcagatttcatggcacctgcacttgaagcaagtcacttctttatcacaggtgtcttgaaacattagcttcttttaccaacctgagaaaattaggatgacctggcaaataagatcttgaataggccaaaagcaagtatcttgctgtgtgtagtctcttggttaaagtgaagaaacagtactgttcacacctttcttcactgagattccagtgtacatgagaacatatatttattgcatgattttctagatacacagtctatgcattattcatatacatttattttagcctaaagtggttttcaaatccagttcttcaagccataaatgaccaagatccaagcaatctgaatttgtttttgtgattatttgactggaatgcttcttaagtggaataactatactccgttatccacccgatttcctaatgtaattgaaagattttctattttgccacacacttggagacaataagggtttttagttttatctactcttctattgaagttaaagaaagaaaaaaagatttttttatttgtattaatgaaaagctttagtttaaaataaggagatccagaataaaaagaagagactgatctcttcaattattgtcatctgtagccaccagcacatcactcttatgtaatccccaaaggcttggcatgccgtaagtgtgtggtgggtagactgctgccggggaatcgtacttcttatttagtaatgataagacttttcattatttttggaattttaaagatgacataaataagtttaaatatcaatttggggagtaaggtttaatattgccatcgggtattgagacaggaggaagtttctgtttttctccatttagacataggtcaattaaaatatttgggtttaaaatgactaaatgctttaaacatattgtagcttaagatatatgtgttaagatatatacatgagaaactttaaaaggtaactactgtgcatgcctgatgcttaatagaatacttagtggcatcaaatgtttgcagcagtctccataattatattcagtcccttctaatactgtatcaatgtaaatgaaataaatatattcaaattggctttttgatatgcatcaagtggcattttgttcctgtgtttaatagtgatctgtatacagctgtgcacatattgtcatcacttattctagcatcactgttaaggctgtgattatgtttgatattcacctggattttaatacaagccaatatcagcttcccattgtgtaataacttgggtgtttaggagtcttttcacattttttggggatatgaactagatgttcaagaactccttctggactgtggatactgaatcagtgtactattggctgcagaatttgtttcaattgaaaatagactcaggaagattgctgctcagaatatcatataatgtttattttttgaggtgtttttgtttttatttgtgtgtttttttttttttaagtcagcttggaacttttttcctgggtagtatttgggagagggaaaggctgtactatatatttatttctaaatgttttgactgggcatttttcttttaatgaaatatgtggactgctctagcaaaccctattttcagctactatttgaatattcttgaacaccaccactgaagagtttcatatacaccaaataatgtctcatctctatagtacagggaatataaaattggtttcctgtggtcatgatcaagatagtagtattattacacaagaaacttggtctgcagtctggaagcttgtctgctctatagaaatgaaaatgcagcatgaagttgacattgtggaaatgaaagtaattgggtattagaaatctgaaagtactgtcatctaaaagcaattgtgattttattgtaattggttgtcactgttgtacggtgtctagaattaaagaatacatgtaaactttcatggtatttagcctttcttaaatttttttaaaatttaaactttctaacctatgtattcaacttctgtatttatatttaatcagtggttcatgttatataatacacccttaactagttaaatggaatgttggtatggtacagagtaccatattgctaagaaaactgtcttataaaagatgtatatgtgtgaagacatgaaagtttaatgtacagaatggttggagaaatgcctatggtgaattaaagcttcatatctgctttctg

SEQ ID NO: 172803 - DNA, 2554 bp, Homo sapiens
  Payload ID: 13967
  Gene Symbol: PDP1
  Gene Name: pyruvate dehyrogenase phosphatase catalytic subunit 1
  Uniprot ID: Q9P0J1
  ENST ID: ENST00000520728
  CDS Start-End: 226-1839
acggtaggggagcagagtgggcaggccgggggtgagggctcgcgctccgggagctgcacggggctgcgtggaaagagcgccgagcggtggcgtcgttgtcgccccctcctcgtcgggaagaatcgtttggtctcctgccgtgcccggagaatgtgtgtgtgtcccgggcccagacgaattggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgcaggttgtgcttgttcccaggcagtcagtgaaagactcttttattatattgctgtctctttgttaccccatgagactttgctagagattgaaaatgcagtggagagcggccgggcactgctacccattctccagtggcacaagcaccccaatgattactttagtaaggaggcatccaaattgtactttaacagcttgaggacttactggcaagagcttatagacctcaacactggtgagtcgactgatattgatgttaaggaggctctaattaatgccttcaagaggcttgataatgacatctccttggaggcgcaagttggtgatcctaattcttttctcaactacctggtgcttcgagtggcattttctggagccactgcttgtgtggcccatgtggatggtgttgaccttcatgtggccaatactggcgatagcagagccatgctgggtgtgcaggaagaggacggctcatggtcagcagtcacgctgtctaatgaccacaatgctcaaaatgaaagagaactagaacggctgaaattggaacatccaaagagtgaggccaagagtgtcgtgaaacaggatcggctgcttggcttgctgatgccatttagggcatttggagatgtaaagttcaaatggagcattgaccttcaaaagagagtgatagaatctggcccagaccagttgaatgacaatgaatataccaagtttattcctcctaattatcacacacctccttatctcactgctgagccagaggtaacttaccaccgattaaggccacaggataagtttctggtgttggctactgatgggttgtgggagactatgcataggcaggatgtggttaggattgtgggtgagtacctaactggcatgcatcaccaacagccaatagctgttggtggctacaaggtgactctgggacagatgcatggccttttaacagaaaggagaaccaaaatgtcctcggtatttgaggatcagaacgcagcaacccatctcattcgccacgctgtgggcaacaacgagtttgggactgttgatcatgagcgcctctctaaaatgcttagtcttcctgaagagcttgctcgaatgtacagagatgacattacaatcattgtagttcagttcaattctcatgttgtaggggcgtatcaaaaccaagaatagtgagtggctctttcactggcaattctcaaatgatatacatttaaagggcagattttttaaaaagatactactataataaacatttccagttggtcattctaagcatttacccttttgatactctagctagtcaggtactccaaattgactttgcagcagggtggcagggtcaggagagtctggtcctgcctagctcagatttcatggcacctgcacttgaagcaagtcacttctttatcacaggtgtcttgaaacattagcttcttttaccaacctgagaaaattaggatgacctggcaaataagatcttgaataggccaaaagcaagtatcttgctgtgtgtagtctcttggttaaagtgaagaaacagtactgttcacacctttcttcactgagattccagtgtacatgagaacatatatttattgcatgattttctagatacacagtctatgcattattcatatacatttattttagcctaaagtggttttcaaatccagttcttcaagccataaatgaccaagatccaagcaatctgaatttgtttttgtgattatttgactggaatgcttcttaagtggaataactatactccgttatccacccgatttcctaatgtaattgaaagattttctattttgccacacacttggagacaataagggtttttagttttatctactcttctattgaagttaaagaaagaaaaaaa

SEQ ID NO: 172804 - DNA, 596 bp, Homo sapiens
  Payload ID: 13967
  Gene Symbol: PDP1
  Gene Name: pyruvate dehyrogenase phosphatase catalytic subunit 1
  ENST ID: ENST00000518573
  CDS Start-End: 213-596
aagaatcgtttggtctcctgccgtgcccggttcgtattccctactccctgccacgagccgccccgtccgggatcctccacccgtccaaagttgtgagggggcgccgggcgtgctcgcggatcggcggccgcgggcgtgcggagggctggacgagccctggagcgccaggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagt

SEQ ID NO: 172805 - DNA, 544 bp, Homo sapiens
  Payload ID: 13967
  Gene Symbol: PDP1
  Gene Name: pyruvate dehyrogenase phosphatase catalytic subunit 1
  ENST ID: ENST00000521144
  CDS Start-End: 104-544
aacatttgagcacatcttctggctcagtcatgtacacttaacctctggatgactttcaggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgca

SEQ ID NO: 172806 - DNA, 581 bp, Homo sapiens
  Payload ID: 13967
  Gene Symbol: PDP1
  Gene Name: pyruvate dehyrogenase phosphatase catalytic subunit 1
  ENST ID: ENST00000518107
  CDS Start-End: 352-581
agagtgggcaggccgggggtgagggctcgcgctccgggagctgcacggggctgcgtggaaagagcgccgagcggtggcgtcgttgtcgccccctcctcgtcgggaagaatcgtttggtctcctgccgtgcccggttcgtattccctactccctgccacgagccgccccgtccgggatcctccacccgtccaaagttgtgagggggcgccgggcgtgctcgcggatcggcggccgcgggcgtgcggagggctggacgagccctggagcgccaggagaatgtgtgtgtgtcccgggcccagacgaattggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaa

SEQ ID NO: 172807 - DNA, 2140 bp, Homo sapiens
  Payload ID: 13967
  Gene Symbol: PDP1
  Gene Name: pyruvate dehyrogenase phosphatase catalytic subunit 1
  Uniprot ID: Q9P0J1
  ENST ID: ENST00000517764
  CDS Start-End: 244-1857
attcaccgggctggagcgagacctcgcccctcctccgctcccgcctccccgccgccgcctcctctaatgagcatctctgccttgctttcaatgggccggtgctgctgtcgctgctgctgcccgcgcgggttgtggatgttgtcggctccgtgttgtgatgacaggagaatgtgtgtgtgtcccgggcccagacgaattggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgcaggttgtgcttgttcccaggcagtcagtgaaagactcttttattatattgctgtctctttgttaccccatgagactttgctagagattgaaaatgcagtggagagcggccgggcactgctacccattctccagtggcacaagcaccccaatgattactttagtaaggaggcatccaaattgtactttaacagcttgaggacttactggcaagagcttatagacctcaacactggtgagtcgactgatattgatgttaaggaggctctaattaatgccttcaagaggcttgataatgacatctccttggaggcgcaagttggtgatcctaattcttttctcaactacctggtgcttcgagtggcattttctggagccactgcttgtgtggcccatgtggatggtgttgaccttcatgtggccaatactggcgatagcagagccatgctgggtgtgcaggaagaggacggctcatggtcagcagtcacgctgtctaatgaccacaatgctcaaaatgaaagagaactagaacggctgaaattggaacatccaaagagtgaggccaagagtgtcgtgaaacaggatcggctgcttggcttgctgatgccatttagggcatttggagatgtaaagttcaaatggagcattgaccttcaaaagagagtgatagaatctggcccagaccagttgaatgacaatgaatataccaagtttattcctcctaattatcacacacctccttatctcactgctgagccagaggtaacttaccaccgattaaggccacaggataagtttctggtgttggctactgatgggttgtgggagactatgcataggcaggatgtggttaggattgtgggtgagtacctaactggcatgcatcaccaacagccaatagctgttggtggctacaaggtgactctgggacagatgcatggccttttaacagaaaggagaaccaaaatgtcctcggtatttgaggatcagaacgcagcaacccatctcattcgccacgctgtgggcaacaacgagtttgggactgttgatcatgagcgcctctctaaaatgcttagtcttcctgaagagcttgctcgaatgtacagagatgacattacaatcattgtagttcagttcaattctcatgttgtaggggcgtatcaaaaccaagaatagtgagtggctctttcactggcaattctcaaatgatatacatttaaagggcagattttttaaaaagatactactataataaacatttccagttggtcattctaagcatttacccttttgatactctagctagtcaggtactccaaattgactttgcagcagggtggcagggtcaggagagtctggtcctgcctagctcagatttcatggcacctgcacttgaagcaagtcacttctttatcacaggtgtcttgaaacattagcttcttttaccaacctgagaaaa

SEQ ID NO: 172808 - DNA, 1284 bp, Homo sapiens
  Payload ID: 13967
  Gene Symbol: PDP1
  Gene Name: pyruvate dehyrogenase phosphatase catalytic subunit 1
  ENST ID: ENST00000518827
  CDS Start-End: 587-1284
atagaacgctcattaattacagcacagttttcataaattccaacttccctaggaattttgtcttttgaaggcatgttggaagttggggcattaggatataatctcagtccatgtactaagcctctgcataactgaaagatagagtcaataaaattcactctctcattttttgtttttaatctcaagaatttttgccttgaaggaaaaatgtagtggagaatttgatgtttgaacgttagaagagtgagactcaaagatgtgagctgacttttccaagattatttgggagttggtggcagacctatgcccgttagcctggcaaattgccacagtggactagagaagcaagttttgcaagaccatctactgggctttccccagccaaatctgttgtacattctgcacagtttgtactgcacaaaggacgacaaagaaaagagaaaattgaagtttgagtataggagccaggagttcagtcgtggttccacgaatgattgggagttgtgcctgccagaatataccctgtagaaatagtacatgatgaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgcttccacaccacagaaattttacctcacacctccacaagtcaatagcatccttaaagctaatgaatacagtttcaaagtgccagaatttgacggcaaaaatgtcagttctatccttggatttgacagcaatcagctgcctgcaaatgcacccattgaggaccggagaagtgcagcaacctgcttgcagaccagagggatgcttttgggggtttttgatggccatgcaggttgtgcttgttcccaggcagtcagtgaaagactcttttattatattgctgtctctttgttaccccatgagactttgctagagattgaaaatgcagtggagagcggccgggcactgctacccattctccagtggcacaagcaccccaatgattactttagtaaggaggcatccaaattgtactttaacagcttgaggacttactggcaagagcttatagacctcaacactggtgagtcgactgatattgatgttaa

SEQ ID NO: 172809 - DNA, 341 bp, Homo sapiens
  Payload ID: 13967
  Gene Symbol: PDP1
  Gene Name: pyruvate dehyrogenase phosphatase catalytic subunit 1
  ENST ID: ENST00000520614
  CDS Start-End: 126-341
ctcgtcactgcgcagccaatcggcaggcgggaagcactccggcccgaacgtgcgggcggggcagggtggcggccccgcacggaatcccagtcagaagttccagcctgccactgttctctgatgccatgccagcaccaactcaactgttttttcctctcatccgtaactgtgaactgagcaggatctatggcactgcatgttactgccaccacaaacatctctgttgttcctcatcgtacattcctcagagtcgactgagatacacacctcatccagcatatgctaccttttgcaggccaaaggagaactggtggcagtacacccaaggaaggagatatgct

SEQ ID NO: 172810 - DNA, 7146 bp, Homo sapiens
  Payload ID: 13968
  Gene Symbol: PDP2
  Gene Name: pyruvate dehyrogenase phosphatase catalytic subunit 2
  Uniprot ID: Q9P2J9
  ENST ID: ENST00000311765
  CDS Start-End: 335-1924
agcacccaggcagggggtaaggggcggtgttgccccctcccgggtcccgcctttctgcccgcctctcatcctctttagccattgggcaatacctctgtccatcaagggcccgcctccgcaattgagccaaccagggctggcgggagggcgcttccttctggagctgggtcctgactagggaccgcctgggtgaggtgaggacctggtggccgcagttgtggcactgtgcgcaggcgctgaactgaccggacggagcgggcggctgtggcctcgccagctggtttaaaaatatccttttttgctgaaggaacacatttgctggtatagtttcagaatgtcaagtactgtgtcctactggatcttaaattctacaaggaacagcattgccacattgcaagggggtagacgcttatactccaggtatgtctcaaataggaataaattaaaatggaggctcttttcccgggtgccacccaccctaaacagttccccatgtggtggctttactctgtgcaaagcctacagacacacatcaacagaggaagatgattttcacttgcaactcagccctgagcagataaatgaagtgcttcgagctggcgagacaacccacaagattcttgaccttgaaagcagagtcccaaattcagtgttgcggtttgagagcaaccagctggctgccaattccccagtggaggaccggcgaggtgtagcctcctgcctgcaaaccaatggactgatgtttggcatcttcgatggacatggtggtcatgcatgtgcccaagcagtgagcgagaggctcttctactatgtggcagtgtccctgatgtcccaccagaccctggagcacatggagggagctatggaaagcatgaaacccttgctgcccatcctgcattggctcaagcacccaggggacagtatctacaaggatgtcacatctgtgcatcttgaccacctccgtgtctattggcaggaactgcttgatttgcacatggaaatgggactaagcattgaagaagcattaatgtactccttccagagactggattctgacatctcgctggaaatccaggcccccctggaagatgaggtgacaaggaacctgtcactccaggttgctttctctggggcaacagcttgcatggcccatgttgatggaattcacttgcacgtggcaaatgctggtgactgccgagccatccttggtgtccaagaggacaatggcatgtggtcttgtctgccccttacacgtgaccacaatgcctggaaccaggccgagctgtcccggctaaagagggagcaccctgagtcagaggacaggacgatcatcatggaggacaggctactgggcgtcctcatcccctgcagggcctttggggatgttcagctgaagtggagtaaagagttgcagcgcagcattctggagaggggcttcaataccgaggccctcaacatttaccagttcacacccccacactactacactccaccctacctgactgctgagcctgaggtcacataccacaggctgaggccccaggataagttccttgtgctggcctcagatggcctgtgggacatgctgagcaatgaggacgtggtaaggctggtggtggggcacctggctgaggcagattggcacaagacagacctggcccagagacccgccaacttggggctcatgcagagcctgctgctgcagaggaaagccagcgggctccacgaggctgaccaaaatgcagccacgcggctgatcagacatgccatcgggaacaatgagtatggggagatggaggcagagcggctggcggcgatgctgacattgccagaggacttggcgaggatgtacagggatgatatcactgtcactgtggtgtattttaactcagaatcaatcggtgcatattacaaggggggttaagaatctcccatcctattgtcaaggttaacataaatgctcttctaaaatgtttcacttactcctaaactagctatccaaaccttactattaaaagcgcaggcagatttaatttgctaaatagactaacaggaggaaaaaaacaaacagcctagctttaaaaaacagtgaaatagcagtgatttcatgtccctgtatgttctgattaagtcttatatgcagagaggacagagcataaagtctatagaattggcttgggcttgtgtagccccagtcatttgataaagatgttgttaaactgtgtcagcctgagccttcaaagggtaaatttaatcatgattctgagaataaagaacttcaggagcttcttaggtcttgccacaaaaatctgcaaatttgataattctcctgaattcacaatcatggacttgtagactatgaagagatattttatttgtttgtcttttatttaaattactaaggtctaggtttacaaagcatactacaggacccttttctatgcaatatcctaacttttttttttgtgattatgcttgtgagaaattttgtaatactacattctagttctgttttcgtttattttaaaactgaatccttaaacttgcaaacacgcctactgtaagcatgcttggaatgacttgttttggttttcagctgataggatctatgcctctggaccagctgaacttactggtgcagctttttgtgccctctactgagtcccattccagaaactttgagccatgctaggaggtaactagtctatgccttaactcctgacctttcctgcattagtaaaatttcctcctgggctgagcctttgggggttgattcacagcatttaagctttctgattatacctctcaaacattcttctgtcaattccacacaatccttctacctctgctatgctgaacccctcattcaccctgcacctgccaactgcaaaatattgtctgaaagaatctttcacatgttcctgcttcctatggctgcaggaaaggagaaaatgtgattgcatgtggtagttgtggtgatagacgtttagacaggacaggttaatttagcggattgtggacttaagattcaacctctatctggagaggtgaaaacacaaaggcttaaggacaacagtttctaaccaagtttctctgaatcctttcctgagaggtggtgggcaggagggaggagtgagacttatcagatgggacgcttgccccaagactgtgggataaaccaccattgctagtcctcaggaattagaccatatttagtataggagttggggcaaaaataaaagtgtaatttgtaatggtttctgtgggctgtagactctttgtatttacttggaaattcagttatgtggatccattttggagatgaatttcatctcatgagttgctgtggcatttaaacaacaggaaatgtgtccctaaatggaaacaaatataatcccacaaaaccaacaattttatttgcctctactacgtcaggcagaattcttcaattaagttgaactacatttgttgatcccttttctcatcttacccctttatgccacctactgaaaagaaaaacaaatagctaggtttggtttcctgttttttgtctatgtcccagctgacattcagtcaaatgttgggatacttctaatttggtggtgtttctttgtacatttttcagtgcaactgtttagtcatgtgttttcatctaagaaattatcttttgaatatttaagccttgatccttttattctgaaaccattaatattccttcttggctgggtgcagtagtttacgcctgtaatcccagcactgtgggaggccgaggcggatggatcacctgaggtcgggaattcgagaccagcctgaccaacatggagaaactccatctctactaaaaatacaaaattagccaggtgtggtggtgcatgcctgtaatcccagctactcgggaggctgaggcaggaaaatcacttgaacccgggaggcggaggttgcggtgagccaagatcgcaccattgcactccagcctgggcaacaagagtgaaactctgtctcaaaaaaaaaaaaaaaaaatccatcttatctcttagtccgtccttccttccttccttccttccttccttccttccttccttccttccttccttccttccttccttcctctctctctctttctttctttctttccttcttgacagggtctccctgtagccaggctggagtgcaatggcatgatcttggctcactgcaacctctgcagcccaggctcaaacgatcctcctgcctcagcctcccgagtagctgggactatgcaccaccatgcctggctaatttttttaattttttgtagagacagggttttgccatgttgcccaggctggtctcaaactcctagactcaagcaatctgcccacctcggcctcccaaggtgctgggatgataggcatgagccaccgcacccagcctatctcctagatcttgaatcaaaaataaaatgtaaatcacttccattctgctagcatgagggtttgttgctaaaattgaggattctatctgacgtttactttttgttgttttttgagacaaggtcttgctttgtcgcccatgctggagtgcagtggcatcattataactcactgtcaaactcctggactccaatgttccctccccttttagcctcccaagtagctgggtctacaggcatgaaccatcaggcccagataattaaaaaaactttttttggtgaaaacatgatcttgctatgttgctcaggctggttgtctggcattttctttgtcctttattctttatactagctaaaccctggagtatccttgaagcctttactggcatacagagtacctgaatcttactttggagcctagcatgggtcataaatatatctgattcattaacctgtgagacagctgagagaacacagactccttacctgtatctccaggcatatctggtttttctctgcctaatagattttcctgctttctagttagtaatattgagaaagaagaaaggcttatttatcatttgctttttttccactgtgaatcatctgttctttccatgaacattctggggagcacctcctgattaaactcctgtctccctgaccactatcctgctgtcattggacttcttgaagcacatgggctactgccccaggacactgggatttgagaggagtttagtggtaattgtcaggtctttcaaagcatttattattccttttatacggagatttcagtattgagacttaaaatgaactgaaaaatgagattgaacatttaatattttggatgtaacttttgaagaaagtatgctttggtgcttaaaattgtatatgattttaggtaagaaactttgataatattggcataatttagatttattttctttcttttttttgagacagtctcactcagtcgcccaggctgaagtgcagtgacacagtctcagctcactgcaacgtctgcctcccagattgaagtgactctcgtgcctctgccacagagtagctgggattacaggcatgcaccaccacacaccgctaattttttgtatttttagtagagacagagtttcaccatgttggccaggctgcgaactcctgagctcaagtgatcctcccacctcagcttcccaaagtgctagcattacaggcatgagccaccacacctcaccagatttttaaaaaatatataactgcatctctcttgattctggggcttggtaaaaatggatagataagatagtattctaaattcaaattcgtggctaggcacagtggcccacacctgtaatcccagcactttgggattccaagacagaagactcacttgagtacagtatgagaccagcctgggcaacatagatcttgcctctacaaaaaaaaaaaaaaatagccaggtgtggcacatgcctgtagtctcagctgcttggaaggctgaaatgagaggatctcttgagcccaggaggtctaggccagagtgagctgtgatcgtgccattgcactccagactgagtgacagagtgagactgtgtctaaaaaaaaagtttgaattaaaaaaaaaaaaaaaaaagtcggctgtgcacggtggctcatgcctgtgatcccagcactttcggaggccaaagtgggtggattacctgaggtcaggagtttgagaccagcctgaccaacatggtaaaactccatctctactaaaaatacaaaaattagcctggaatagtggcgcatgcctgtaatcccagctacttgtgaggctgaggcaggagaatcccttgaacccagaaggcagaggttgcagtgagctgagattgtgccattgcactccagcctgggcaacatgagcgaaactccatctcaaaaaaacaaaaacaaaaaacaaactcaaattagcatgatagatcaggctacttagattcagctttctgagatgttatttgttaacattaaggctaatttattataatgaaaatgtaaactttgaggtatgttaatatataaacatctttttcctttggcctaaaaggtctttagtattcagcacactgggtaaagttcagtttagacacaatcaaattggcatcttttaaacataagtgaaatatagagagcttgaacttgagttacttaaagaagatacagtataattaattatacagaacaaaacaaagatgtgtttagagtgactctggcctgactcttgtccatcagcccctagtagcctatcttcagcctttgggaagtcttaacttcccaggttaaactagaatattctggaactgagctgtccaaatttcatcttaaagtggatcatttgactctgaaacacgattctcatggcagaaaaagccctggtgtttccttggagctggggataaaggccagtgagccagcctgtgatgagagctgcccctggcactatctgagtggaaagctcattgggacagccatgcagctatcagagccgactgaagccctgtcccttacccctcaggcacctgatgcttaacttgcctcctgggaaataatgatctagcatttacttggaacaatgattaatcatgttctttaataattgctgacatttgtattttaagctgtataccaatgttcgtatttgacattgattttctaaccattagagatatttaattaaaacttggaaatgaaagaaa

SEQ ID NO: 172811 - DNA, 848 bp, Homo sapiens
  Payload ID: 13968
  Gene Symbol: PDP2
  Gene Name: pyruvate dehyrogenase phosphatase catalytic subunit 2
  ENST ID: ENST00000566776
  CDS Start-End: 122-848
cggacggagcgggcggctgtggcctcgccagctggtgagaagcgggcgagggtccgaggtagggaaggtttaaaaatatccttttttgctgaaggaacacatttgctggtatagtttcagaatgtcaagtactgtgtcctactggatcttaaattctacaaggaacagcattgccacattgcaagggggtagacgcttatactccaggtatgtctcaaataggaataaattaaaatggaggctcttttcccgggtgccacccaccctaaacagttccccatgtggtggctttactctgtgcaaagcctacagacacacatcaacagaggaagatgattttcacttgcaactcagccctgagcagataaatgaagtgcttcgagctggcgagacaacccacaagattcttgaccttgaaagcagagtcccaaattcagtgttgcggtttgagagcaaccagctggctgccaattccccagtggaggaccggcgaggtgtagcctcctgcctgcaaaccaatggactgatgtttggcatcttcgatggacatggtggtcatgcatgtgcccaagcagtgagcgagaggctcttctactatgtggcagtgtccctgatgtcccaccagaccctggagcacatggagggagctatggaaagcatgaaacccttgctgcccatcctgcattggctcaagcacccaggggacagtatctacaaggatgtcacatctgtgcatcttgaccacctccgtgtctattggcaggaactgcttgatttgcacatggaaatgggactaagcattgaagaagcattaatgtactccttccagagactggattctgacatct

SEQ ID NO: 172812 - DNA, 362 bp, Homo sapiens
  Payload ID: 13968
  Gene Symbol: PDP2
  Gene Name: pyruvate dehyrogenase phosphatase catalytic subunit 2
  ENST ID: ENST00000568398
  CDS Start-End: 281-362
ctgactagggaccgcctgggtgaggtgaggacctggtggccgcagttgtggcactgtgcgcaggcgctgaactgaccggacggagcgggcggctgtggcctcgccagctggtgagaagcgggcgagggtccgaggtagggaaggtaacgagcgggggatgtggacacctctttccccgccaggcctcgccggcgcctgaccctcccggcctgcggcaccggctcaggtttaaaaatatccttttttgctgaaggaacacatttgctggtatagtttcagaatgtcaagtactgtgtcctactggatcttaaattctacaaggaacagcattgccacattgcaagggggtagacgcttatact

SEQ ID NO: 172813 - DNA, 598 bp, Homo sapiens
  Payload ID: 13968
  Gene Symbol: PDP2
  Gene Name: pyruvate dehyrogenase phosphatase catalytic subunit 2
  ENST ID: ENST00000568869
  CDS Start-End: 134-598
cttctggagctgggtcctgactagggaccgcctgggtgaggtgaggacctggtggccgcagttgtggcactgtgcgcaggcgctgaactgaccggacggagcgggcggctgtggcctcgccagctgtttcagaatgtcaagtactgtgtcctactggatcttaaattctacaaggaacagcattgccacattgcaagggggtagacgcttatactccaggtatgtctcaaataggaataaattaaaatggaggctcttttcccgggtgccacccaccctaaacagttccccatgtggtggctttactctgtgcaaagcctacagacacacatcaacagaggaagatgattttcacttgcaactcagccctgagcagataaatgaagtgcttcgagctggcgagacaacccacaagattcttgaccttgaaagcagagtcccaaattcagtgttgcggtttgagagcaaccagctggctgccaattccccagtggaggaccggcgaggtgtagcctcctgcctgcaaaccaatggactgatgtttggcatcttcgatggacatggtggtcatgcatgtgcccaagcagtgagcgagagg

SEQ ID NO: 172814 - DNA, 560 bp, Homo sapiens
  Payload ID: 13968
  Gene Symbol: PDP2
  Gene Name: pyruvate dehyrogenase phosphatase catalytic subunit 2
  ENST ID: ENST00000566543
  CDS Start-End: 106-560
gttttattgtgaccacgtccttgggtccaggaggctggccaggctgcccaggtttaaaaatatccttttttgctgaaggaacacatttgctggtatagtttcagaatgtcaagtactgtgtcctactggatcttaaattctacaaggaacagcattgccacattgcaagggggtagacgcttatactccaggtatgtctcaaataggaataaattaaaatggaggctcttttcccgggtgccacccaccctaaacagttccccatgtggtggctttactctgtgcaaagcctacagacacacatcaacagaggaagatgattttcacttgcaactcagccctgagcagataaatgaagtgcttcgagctggcgagacaacccacaagattcttgaccttgaaagcagagtcccaaattcagtgttgcggtttgagagcaaccagctggctgccaattccccagtggaggaccggcgaggtgtagcctcctgcctgcaaaccaatggactgatgtttggcatcttcgatggacatggtggtcatgcatgtgcccaagcagt

SEQ ID NO: 172815 - DNA, 574 bp, Homo sapiens
  Payload ID: 13968
  Gene Symbol: PDP2
  Gene Name: pyruvate dehyrogenase phosphatase catalytic subunit 2
  ENST ID: ENST00000561704
  CDS Start-End: 265-574
tggagctgggtcctgactagggaccgcctgggtgaggtgaggacctggtggccgcagttgtggcactgtgcgcaggcgctgaactgaccggacggagcgggcggctgtggcctcgccagctgaaaccaggtctccttatgttgcccaggctggtcttggaactcctaggctcaagtgatcctcccgcctcagcctttggagtggttacaggtttaaaaatatccttttttgctgaaggaacacatttgctggtatagtttcagaatgtcaagtactgtgtcctactggatcttaaattctacaaggaacagcattgccacattgcaagggggtagacgcttatactccaggtatgtctcaaataggaataaattaaaatggaggctcttttcccgggtgccacccaccctaaacagttccccatgtggtggctttactctgtgcaaagcctacagacacacatcaacagaggaagatgattttcacttgcaactcagccctgagcagataaatgaagtgcttcgagctggcgagacaacccacaagattcttgaccttgaaagcagagtcccaa

SEQ ID NO: 172816 - DNA, 2083 bp, Homo sapiens
  Payload ID: 13969
  Gene Symbol: PKLR
  Gene Name: pyruvate kinase, liver and RBC
  Uniprot ID: P30613
  ENST ID: ENST00000342741
  CDS Start-End: 40-1764
cattccatggtcccgcagccccaggcccacactgaaagcatgtcgatccaggagaacatatcatccctgcagcttcggtcatgggtctctaagtcccaaagagacttagcaaagtccatcctgattggggctccaggagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgcgggtgctaagcatatcctgagacgcccctccctcctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattccctgcatccaatctgctcagcaggccctaagatgccttgagtctttaatccca

SEQ ID NO: 172817 - DNA, 2479 bp, Homo sapiens
  Payload ID: 13969
  Gene Symbol: PKLR
  Gene Name: pyruvate kinase, liver and RBC
  Uniprot ID: P30613
  ENST ID: ENST00000392414
  CDS Start-End: 115-1746
actttaaccagtctgcagaactgatccccagcccagctgggcctcatgcctctgacaacccaacagtgtggagcagacccacagagagggagacccagagaggtgtgcagtggcatggaagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaagccccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtgctgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgcgggtgctaagcatatcctgagacgcccctccctcctctggcccagcctacccttgtaccccatcccttcctccccagtctacgttctccagcccacacccctccaaagccccacctttaagtcctctcttctctattcctgaccctccctacctgaggcctatctgagactataactgtcatctagccccttcgaggttgccccttccccatctccatttcacacaggtcctgaaagtctgtgtccaattatgcactggccacccaacagcaccaattgtacattccctgcatccaatctgctcagcaggccctaagatgccttgagtctttaatcccagtttggctggttaattccataaccccaggcatcccatcccttggggtgggggagaggggagacagggcaatcttgtccacagtctcccattctcatatgtagccctcatgataatctgggcatctcgtgccagggcaggctaccccttcatggtgactaacagttacatgaaagtccacgcttttgggaaaactgggtgggatggatgctggggagaagtgagggctgggcagctgattttgtcactgtcttcacaacctccgtgctgggcttgtagaccactgtcctggctgctctcatgcctgcctgataccctgcttggtcaaatccccggctgcttccttctgcacccagaaattccttcccactcatgttgttcccacacacaaaccaagagccaaaaatgagtgtgtc

SEQ ID NO: 172818 - DNA, 580 bp, Homo sapiens
  Payload ID: 13969
  Gene Symbol: PKLR
  Gene Name: pyruvate kinase, liver and RBC
  ENST ID: ENST00000434082
  CDS Start-End: 1-141
atgcctctgacaacccaacagtgtggagcagacccacagagagggagacccagagaggtgtgcagtggcatggaagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctcc

SEQ ID NO: 172819 - DNA, 580 bp, Homo sapiens; identical to SEQ ID NO: 172818
  Payload ID: 13969
  Gene Symbol: PKLR
  Gene Name: pyruvate kinase, liver and RBC
  ENST ID: ENST00000573938
  CDS Start-End: 1-141

SEQ ID NO: 172820 - DNA, 2083 bp, Homo sapiens; identical to SEQ ID NO: 172816
  Payload ID: 13969
  Gene Symbol: PKLR
  Gene Name: pyruvate kinase, liver and RBC
  Uniprot ID: P30613
  ENST ID: ENST00000572740
  CDS Start-End: 40-1764

SEQ ID NO: 172821 - DNA, 2479 bp, Homo sapiens; identical to SEQ ID NO: 172817
  Payload ID: 13969
  Gene Symbol: PKLR
  Gene Name: pyruvate kinase, liver and RBC
  Uniprot ID: P30613
  ENST ID: ENST00000571194
  CDS Start-End: 115-1746

SEQ ID NO: 172822 - DNA, 2717 bp, Homo sapiens
  Payload ID: 13970
  Gene Symbol: PKM
  Gene Name: pyruvate kinase, muscle
  Uniprot ID: P14618
  ENST ID: ENST00000319622
  CDS Start-End: 501-2096
agtcccaccgaaagggcaacctgcccgcgcgttccgccgccgccgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggaggtgagcggtgcaggaggctacgccatcagtccccaccaagggccagtcgcccggctagtgcggaatcccggcgcgccggccggccccgggcacgcaggcagggcggcgcaggatccagggcgtctgggatgcagtggagctcagagagaggagaacggctcctcacgcctggggcctgctcttcagaagtccccagcgccgttccttccagatcaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacc

SEQ ID NO: 172823 - DNA, 2318 bp, Homo sapiens
  Payload ID: 13970
  Gene Symbol: PKM
  Gene Name: pyruvate kinase, muscle
  Uniprot ID: P14618
  ENST ID: ENST00000335181
  CDS Start-End: 105-1700
gaggcagtggctccttgcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagc

SEQ ID NO: 172824 - DNA, 2279 bp, Homo sapiens
  Payload ID: 13970
  Gene Symbol: PKM
  Gene Name: pyruvate kinase, muscle
  ENST ID: ENST00000389093
  CDS Start-End: 285-1658
agtcccaccgaaagggcaacctgcccgcgcgttccgccgccgccgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacc

SEQ ID NO: 172825 - DNA, 2526 bp, Homo sapiens
  Payload ID: 13970
  Gene Symbol: PKM
  Gene Name: pyruvate kinase, muscle
  Uniprot ID: P14618
  ENST ID: ENST00000449901
  CDS Start-End: 355-1905
agtcccaccgaaagggcaacctgcccgcgcgttccgccgccgccgccgcgcttcctcctgaaggtgactgcgcccgcggggacgcagggggcggggcccgggtcgcccggagccgggattgggcagagggcggggcggcggagggattgcggcggcccgcagcgggataaccttgaggctgaggcagtggctccttgcacagcagctgcacgcgccgtggctccggatctcttcgtctttgcagcgtagcccgagtcggtcagcgccggagctctccagggcacaccgtattcagctctgagcggtctttgctagtgaggccaaggagccaccctgagccaaaaggggagcattatgtcaccggaagcccaaccccagagaaccaaaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattgtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacc

SEQ ID NO: 172826 - DNA, 457 bp, Homo sapiens
  Payload ID: 13970
  Gene Symbol: PKM
  Gene Name: pyruvate kinase, muscle
  ENST ID: ENST00000569050
  CDS Start-End: 303-457
cacttcgcagtccctagttctccctactgccgctccagtgccagagcccctccgaaggcggccaggacctccaaccacgcacaagtctgcagctctccccaactttccgttcagctcagtctccgagggtgcgccagagcagacacccggaggagtggggagtggcagggcggggccgggagaatgctgccccggaacccataaatctgggccctgcccagaatttagtcccaccgaaagggcaacctgcccgcgcgttccgccgccgccgccgcgcttcctcctgaaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattgg

SEQ ID NO: 172827 - DNA, 1355 bp, Homo sapiens
  Payload ID: 13970
  Gene Symbol: PKM
  Gene Name: pyruvate kinase, muscle
  ENST ID: ENST00000569857
  CDS Start-End: 124-969
gcgggataaccttgaggctgaggcagtggctccttgcacagcagctgcacgcgccgtggctccggatctcttcgtctttgcagcgtagcccgagtcggtcagcgccggaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggcaagtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacag

SEQ ID NO: 172828 - DNA, 2503 bp, Homo sapiens
  Payload ID: 13970
  Gene Symbol: PKM
  Gene Name: pyruvate kinase, muscle
  Uniprot ID: P14618
  ENST ID: ENST00000565184
  CDS Start-End: 290-1885
cgtggctccggatctcttcgtctttgcagcgtagcccgagtcggtcagcgccggaggtgagcggtgcaggaggctacgccatcagtccccaccaagggccagtcgcccggctagtgcggaatcccggcgcgccggccggccccgggcacgcaggcagggcggcgcaggatccagggcgtctgggatgcagtggagctcagagagaggagaacggctcctcacgcctggggcctgctcttcagaagtccccagcgccgttccttccagatcaggcgggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagc

SEQ ID NO: 172829 - DNA, 2004 bp, Homo sapiens
  Payload ID: 13970
  Gene Symbol: PKM
  Gene Name: pyruvate kinase, muscle
  Uniprot ID: P14618
  ENST ID: ENST00000565154
  CDS Start-End: 349-1944
gagcggtgcaggaggctacgccatcagtccccaccaagggccagtcgcccggctagtgcggaatcccggcgcgccggccggccccgggcacgcaggcagggcggcgcaggatccagggcgtctgggatgcagtggagctcagagagaggagaacggctcctcacgcctggggcctgctcttcagaagtccccagcgccgttccttccagatcaggcggctctccagggcacaccgtattcagctctgagcggtctttgctagtgaggccaaggagccaccctgagccaaaaggggagcattatgtcaccggaagcccaaccccagagaaccaaaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccatta

SEQ ID NO: 172830 - DNA, 2254 bp, Homo sapiens
  Payload ID: 13970
  Gene Symbol: PKM
  Gene Name: pyruvate kinase, muscle
  ENST ID: ENST00000567118
  CDS Start-End: 206-415
gcacagcagctgcacgcgccgtggctccggatctcttcgtctttgcagcgtagcccgagtcggtcagcgccggagctctccagggcacaccgtattcagctctgagcggtctttgctagtgaggccaaggagccaccctgagccaaaaggggagcattatgtcaccggaagcccaaccccagagaaccaaaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattgtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgattgcccgtgaggcagaggctgccatctaccacttgcaattatttgaggaactccgccgcctggcgcccattaccagcgaccccacagaagccaccgccgtgggtgccgtggaggcctccttcaagtgctgcagtggggccataatcgtcctcaccaagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccatttt

SEQ ID NO: 172831 - DNA, 1863 bp, Homo sapiens
  Payload ID: 13970
  Gene Symbol: PKM
  Gene Name: pyruvate kinase, muscle
  ENST ID: ENST00000568883
  CDS Start-End: 145-1245
gcccacttcgcagtccctagttctccctactgccgctccagtgccagagcccctccgaaggcggccaggacctccaaccacgcacaagtctgcagctctccccaactttccgttcagctcagtctccgagggacctcagcagccatgtcgaagccccatagtgaagccgggactgccttcattcagacccagcagctgcacgcagccatggctgacacattcctggagcacatgtgccgcctggacattgattcaccacccatcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagc

SEQ ID NO: 172832 - DNA, 1806 bp, Homo sapiens
  Payload ID: 13970
  Gene Symbol: PKM
  Gene Name: pyruvate kinase, muscle
  Uniprot ID: P14618
  ENST ID: ENST00000568459
  CDS Start-End: 190-1785
gagctcacaatcttaaaatgtatctcctgtaatgctgggagtggggtacgagcttcctgctgtgggagggagggggacaggaagcctcgtaaggtctcaccaggtggcaagcacactggattagaagatgcaggaaagcaccttccagtctgaagatcatttaaagactcagtcatgacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggacgtggacctccgggtgaactttgccatgaatgttggcaaggcccgaggcttcttcaagaagggagatgtggtcattgtgctgaccggatggcgccctggctccggcttcaccaacaccatgcgtgttgttcctgtgccgtgatggaccccagagcccctcctc

SEQ ID NO: 172833 - DNA, 550 bp, Homo sapiens
  Payload ID: 13970
  Gene Symbol: PKM
  Gene Name: pyruvate kinase, muscle
  ENST ID: ENST00000567087
  CDS Start-End: 96-550
cagacacccggaggagtggggagtggcagggcggggccgggagaatgctgccccggaacccataaatctgggccctgcccaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtg

SEQ ID NO: 172834 - DNA, 554 bp, Homo sapiens
  Payload ID: 13970
  Gene Symbol: PKM
  Gene Name: pyruvate kinase, muscle
  ENST ID: ENST00000564178
  CDS Start-End: 50-554
gagaaagctgtctaggtagatgtcagtcagcccagtgacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtgg

SEQ ID NO: 172835 - DNA, 1568 bp, Homo sapiens
  Payload ID: 13970
  Gene Symbol: PKM
  Gene Name: pyruvate kinase, muscle
  ENST ID: ENST00000561609
  CDS Start-End: 114-1568
aaatgtaacgtatcaccaaatctgtgggggagtggggctctgtggggaagatgactcaacctttcaattattctgcttttgagagaattatcttcgctgggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaagaacatctgcaaggtggtggaagtgggcagcaagatctacgtggatgatgggcttatttctctccaggtgaagcagaaaggtgccgacttcctggtgacggaggtggaaaatggtggctccttgggcagcaagaagggtgtgaaccttcctggggctgctgtggacttgcctgctgtgtcggagaaggacatccaggatctgaagtttggggtcgagcaggatgttgatatggtgtttgcgtcattcatccgcaaggcatctgatgtccatgaagttaggaaggtcctgggagagaagggaaagaacatcaagattatcagcaaaatcgagaatcatgagggggttcggaggtttgatgaaatcctggaggccagtgatgggatcatggtggctcgtggtgatctaggcattgagattcctgcagagaaggtcttccttgctcagaagatgatgattggacggtgcaaccgagctgggaagcctgtcatctgtgctactcagatgctggagagcatgatcaagaagccccgccccactcgggctgaaggcagtgatgtggccaatgcagtcctggatggagccgactgcatcatgctgtctggagaaacagccaaaggggactatcctctggaggctgtgcgcatgcagcacctgatagctcgtgaggctgaggcagccatgttccaccgcaagctgtttgaagaacttgtgcgagcctcaagtcactccacagacctcatggaagccatggccatgggcagcgtggaggcttcttataagtgtttagcagcagctttgatagttctgacggagtctggcaggtctgctcaccaggtggccagataccgcccacgtgcccccatcattgctgtgacccggaatccccagacagctcgtcaggcccacctgtaccgtggcatcttccctgtgctgtgcaaggacccagtccaggaggcctgggctgaggac

SEQ ID NO: 172836 - DNA, 560 bp, Homo sapiens
  Payload ID: 13970
  Gene Symbol: PKM
  Gene Name: pyruvate kinase, muscle
  ENST ID: ENST00000566809
  CDS Start-End: 315-560
aacccataaatctgggccctgcccaggtaggccgggacagctggggtggcctgggccgagagccaagaaaagacaccccatctggcagcccaacttggcggcaacaggtggcccggcgcccgggggtctgggaggaaagtcgctccgggggcgggccccgttgccccgccgcgtccccattggtcatcaggtttcttaaaatgtgactctgaatctgtgtccttccgccgcagaatttagtcccaccgaaagggcaacctgcccgcgcgttccgccgccgccgccgcgcttcctcctgaaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgag

SEQ ID NO: 172837 - DNA, 582 bp, Homo sapiens
  Payload ID: 13970
  Gene Symbol: PKM
  Gene Name: pyruvate kinase, muscle
  ENST ID: ENST00000562997
  CDS Start-End: 96-582
agaagtccgccctgagaaaccaaggctgggctgctctcctggagccaggggagtccagtgagtgttttacatacaactctaggacctcagcagccatgtcgaagccccatagtgaagccgggactgccttcattcagacccagcagctgcacgcagccatggctgacacattcctggagcacatgtgccgcctggacattgattcaccacccatcacagcccggaacactggcatcatctgtaccattggcccagcttcccgatcagtggagacgttgaaggagatgattaagtctggaatgaatgtggctcgtctgaacttctctcatggaactcatgagtaccatgcggagaccatcaagaatgtgcgcacagccacggaaagctttgcttctgaccccatcctctaccggcccgttgctgtggctctagacactaaaggacctgagatccgaactgggctcatcaagggcagcggcactgcagaggtggagctgaagaagggagccactctcaaaatcacgctggataacgcctacatggaaaagtgtgacgagaacatcctgtggctggactacaaga

SEQ ID NO: 172838 - DNA, 6964 bp, Homo sapiens
  Payload ID: 13971
  Gene Symbol: QKI
  Gene Name: QKI, KH domain containing, RNA binding
  Uniprot ID: Q96PU8
  ENST ID: ENST00000275262
  CDS Start-End: 552-1529
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaa

SEQ ID NO: 172839 - DNA, 1063 bp, Homo sapiens
  Payload ID: 13971
  Gene Symbol: QKI
  Gene Name: QKI, KH domain containing, RNA binding
  Uniprot ID: Q96PU8
  ENST ID: ENST00000361195
  CDS Start-End: 25-1026
ggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatg

SEQ ID NO: 172840 - DNA, 6085 bp, Homo sapiens
  Payload ID: 13971
  Gene Symbol: QKI
  Gene Name: QKI, KH domain containing, RNA binding
  Uniprot ID: Q96PU8
  ENST ID: ENST00000361758
  CDS Start-End: 1195-2154
gggcggagcgaccctcggaaggggcgtggcgaccgggctcgacgcgcgcacgcgctctggagccccacggctacgtgtcgggccacgtgatgcccaccccgaaagtcccccgtgaagcaacaggacgttaaaaaaaaatttctcttctgcggggtggataagaggttctgaaaaaactatagtaacgggaggcgaggcggaggcagcgctggcgcgtcccgctggaattcctctcgcctgccgcgccagccccgaccgcgcccgcagccccacccgccccgtgccgtggaaagccccgcgccccccccgcggccgtcggccccgcagcccacacccacccgccccgggcgccccgcacggcggcgacccagtccttgcgcccaggcccgccgagcgccgcagtccgtcacactcccgttgcccccgtcgcccgccccgccggggaggcagggaggagggggcgcggcgccggcggctgccccggtcgcggggcggcgggcagcaggcagcgggagcgcgccggccgggacccgctaacggccgccctgcgcggccccgcccgccgcccgcccccggccctccccgcgccgctgcccctccccccgccgccgccgctgctgccgccgccgctggcagcgccgcctgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaa

SEQ ID NO: 172841 - DNA, 9463 bp, Homo sapiens
  Payload ID: 13971
  Gene Symbol: QKI
  Gene Name: QKI, KH domain containing, RNA binding
  Uniprot ID: Q96PU8
  ENST ID: ENST00000361752
  CDS Start-End: 552-1577
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagacttctaggaatctttttcttctcatagcgaagtcaaagctctctctgaatgtactgtgtgatgatgcatcatgcatgaaccttcggtcagggatatcattggtgaagtgatttcaaaaagtattcaaaatttgatatgctgtttagtcactacagtgccctcaaagggcagaagttgcagccttttttatattgcctgccaaaatttgaagtattagaagaaagtgtgccatgagagaaaaacttaaggagttttgaaaagtaatgcaaataacaaaactgcaacactatttttaaaaagataaatatctgagttaaaattactgaatctttattttacacctaaaaaaatatgagaacaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaaaaatatatatatttttggaaatgtagcattttatactttcaagtgttataaaaaaaaagaaaaagaacaaagaaaccctttatttcattaaatgattttttctggtggttgtcaagaaacaaaagaccaaaagagcctttttgtctttcttttttattttttaagtattggaataagtctaaagaaaagaaagtgccttattttccttcatggtcattcagtcaagtgtctcataaagatcagctcctccctcagaatacaagttaatgcatgttactcagtcgcccagtatgtgaaagaagatatgagggagacaaatgagttgatagtttgaattataggatttttgccacgttaccttgatgcaaatttgccaaatctgatactgtgaaaagatttgataacttttctaatgcctgactagtaagttttaaaacatcattctttaaaagaatagtttaatacttttggttattccaatcttcaatgttaacccaaaggattctgagataaaaattatgtgtcatctaaacttcagtttacagacaaaattagagctttgttttatttggagaagggggatgcattcatttgattttgttttttgtttttaattaattgaatataataggatacctagcaaatgttttcacaaaagtgaatctttgtgattttcattctagaaaacaatgttttaaatcacccaaatttaatcacatgtctttatatcataccagataactggtgtagtgtatccttttactgtttcaataacctctgcctcccccaccccttaactttaaaagaatgtgaaaaactagcatcatagtgcatataaatactcaaccacatttcagcttaagcttctaatttctcaagaagttgaaacagttagttatgtagttgaagcaatttgtgtgcaaagcctacatctaaacacttgagtgaataatcattaactgctcagtaccagacgtggcaaatctcaagtgacagtggacccccccccccgcccagcttatcaactcgtcccctcttccacaccttcccagcatcacagtcagaggtcagcaggaagctgagtcattaccttcttggtgacctcccccaccatcttgtctcacttggaaaccgttgtcagtttatttactatgcaatagacattcattgttttgtatccagctagctttggtttaatatgccactgctttgtctttctgttacacatacagttttgatttatttacaatatatgctgtgccattttgatttttatattgtttggttggttgaataaatttgcgacactcaaacacttgaggtgatagttgttaaaaacaataccagtatttgatccagtttcatctcaactatgttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcattctttattgaatttatttcttattaaaatatgtagtttttaagactttttttctgacagtattatgtaattttttagcgtgggtagatgggagtgtcgcttgtatgttatcgtacagctgacatgtatttttgtctattctttattatcttagtttcatgctatgtatgtaccataaccaacctattgcctatgagaaacatgtaagataatgtatttacagccattgttacaagtttataatgtatttttctatcttgttttatatgtatgttatataacattcaaaaagaatttttttcttgattgagaaaaggatacaaaatgcaaaatccacaattttgataactgaaaattgccaattgttttgcagtactttattatattgggtgtcttgtcttttttgggcttttagttagctaatgaatgaatacattagacacttttgggttttagttgggattttacatagcttgcattttaattctttggttctttgctgtttctattaacccacagcattattttaataaatgttataataccaacctactaactctggactttgtctgtttattaacctttatatgtttaattaaaataaacaaataaagacaaaagaatgtaaagtcttgagttactggactaaccctgaagaacgtgaccacagataacatagtgtgacttgtttttatgttgtttgtcagctgacagttttgcacactactgttaaaatggctttggttattctggtcttttagcttgggggccggggcgggtgtgggtgtaggtgcagtagagatgggaacaaagtagcctttgtttgaggcattcttctcttgccacttgcctttcagcatctgcattactaattccacaccttatttttccttctccaaaataatcactgtctgctcacagcatcgagtaaaaagatacattgtcatggtatatacctggagaaaccagtttgattctttgttgaaccatttcttttaatttctgtaaataagtaattttatggtcacattgtaaagcagagaaactgttgatattttacctttatttagatttttgttttaacttgacctttttcctttggaaagcgttgaacttgtttagctaactactcctattaggggagcttaacttgggtaaagtcaaaggcccactggctgtttctcatggtggcctgaagccccgctgctttccagtgaggaaaagaaccctcagcacgttactgagctttcctcaggtatttttttctctgtcacctactttacaaatacagtcagactaaaacattaaacaagaagtttaagggggaataacattgggatttgaaaagttgtatgtgattaatttcttgcatgcaaatcaatttaagatttcttaaatatcttcatgcttttcttggctggaacttgggtaaattaacctgtaattatgaattatttagtttaactcaaggtgcatttttatttcacagattgatacttgcttttttctgtgaaacagttctcctagataccaaaatcctcaggatgaatttttgcatttgtaaataacaatttatctttgtaaattacattttatttatttagagttctaaaattgagggctgaaatgaatgacatgtaatagaagacaaaactgtaccaatacgctgttaaccaatcagactgtccaggtattctcatttcataaatatgtatacacacatataaatacacagagtagtgttagctgatgtgagtgataacagcgaatcaccattgagatggtcatttggatcatgtaaacaaaccgtgtcatgtctctgatgggagcggtgggtagtgtactgttaggtggacaggtcttttaacatgctactatttgtaaaagtttccgttgccataacagttcatgtagtagtctgtgaaaattcgaagctgtctgtcaagctgctaatatacaagttgtcatggtaccatgtaacttaaattgatgaatttctatgcaatttactattctctgaagcctatgaatgcagcctcatctcattttcagttaagggtactttatgtataattatgtcattgctgccttttatgtaggaaatgtaaaaaagttttaaaaggcgaaaataacattacagatttcatttttatacaggttacaatattaaacatgaaactaccaaattccaagaatagtaaaattctagagtcagttgattgattgaaactatttgacaaaacagttgaaagctgagctttcagtcaagaagttggtgaaattaatgtccttaaacttttcctttaggcaaaatgtcagggaaaacttaacatgaaagtagttactcccatacgcaccagtgcagtagctccaggtgtaagaggtcacgaaggcaccctgcccataaaaccaggatgtgcatacgtacacacaatcggtgtctggttatggttttctaaacactacataaggatctgaattttttagtgtgccaaaagcaaacgataggtttaaatgaaattgctcactaccaaatcaagactcttcatatatatacgtgtgtgtatatatatatgtcataacactttcacgtgtgacagcctaaggtttctttagttttaggatggggtggggtgggagtggttttgcatgtttgaccaggatgtgatgcctgtctttattccttgataagaagtagctgttacagcatttcaagcaaattattttaggtagaatagaacttactgccaaatgattatttatttagcaaaaattattctccaacttttcgaattcacaatttttctaagtgcatagagtagttttttacattgtcacgaattccttaatacctttatttaaaatggaaaaaatatggacaatattttagaaatatgtgctacacatctaattttatctgtagtttaagtgatctaaattgagatgcctttgatatgaagagatttaccaacattatatgcactcgtgccttcaatgtggaatcaaactggttaacctcagcacagtcctctcgtttctgtgtttctgctgcactaattgccagggggtgggggagaaggcgaatgaattaattcatagtagaaggaggcgataggtgcagcaaagggcagccacagtgttgattccacattataatgttgttgcctcttcttggcaaaagacaccacattgtgggaagatctcagcttccagggtaaaagttaatttataacttaaaagtgctattaagtttttattaccaaatatatcttttatggtttatattgtagtggtatgtatgaaacatttaaaattttactgtggaaattgtgtatatatatatatatagtcgaaataggtgttcacaggtcacatgtgaacggagaactgcatgaccgtacatgaaatgcaataaaccaactggaaaaagtgcatgtgcttcatcctctcaagccaactgcagctggaaagtgctgcttatcctccacccccagaaaatgcatgtatcaatatgagaataaagaacgcacactttcaattttattgaggctttcaacactatttaaaagaaaatgtaagaatttgacattctggagttattataacattagaaaatgagcataacattcactctgattttagccattaagggagattagtaaacagactgctacagtgttccatagttggactgtgcatccaaaacatttttttatctttaataaatggtacagtttttatgtagttttcgaatgtaagaagaaaggaatgctgaccaaaacttgatttcatcagcttcatgaaaaggactagtgtcattaacctgttgaacagaattggtttattaaaaaaatcatttccagtagtgtgaaacctttacgagtctttaacatctaaatgttatgactccttgtaccttaagttttccagtctttcttatttatatcatctccaagtacctctggctcctttcctcttgctcaccggaaccttagttttcctcaacagaatgctttgttaaagtagcccacagttgcaggatccatagcaccgtcgtgcagactagcagcccaaaggtgtgtttggtttggcttatacggtgttttgctttttaaactacttgccataatttaaaagtggcaacactagacttaaaaaaaaaaaagtctgattgcccatattagattttttttttaattcttcacaaaatctgctcttcctgaaagatcaaagtgtctagaaagcccaaacatgtattcttaacatagtaggcaccagctgaaactgagtaattaaacggtcccctgaagccaagtattccctggttagtcgccaccccaccactccttcctgtctctagtgtcacacttgggctgttgattttcttactcttctcttgctttaatccttccccccggctctctggctcctgtggatatctgtgcttgtttcctggtccaggatggtgatctgactttcaaaccagcttctcaaaaggggtgacataaaatcagttttgatgtttttcctcctgaaaaatcagatgaatattttagtcactgttactcatgcacattgtgttcttatgtttacagaagtgcttaagtgaatggaagcactagacatttggatttccttcctaacgtaatttttaatgattaccccttttatacagtaatttgtggtctttagaaagcagttaaactaattgaccatctaatagttgtactatacatatgtctaaaataatagtcatggtaagtttggcatcatatcttccccaaaaaatgtttattaaaattagattattccagtttaatgctattttgtgaactgtataccctctgaaagcgcttatttttacatgctacacaacagttccaattttaaggagtgtctcctaaaattgggatgaaaatctactgtagtctgttttaaagtatgctatactatgttcattggttacttaactggatattaatataaaggttattacaagaaaaatgatgaagagcaaaaggagaagaaaatatttgcaagtgaatccacaattcttgcagaactatttgagttgatactaaagattttatgttcactcctttaccttagaactgtcaagcttgggaatgaggaaagtgccttggctgtgcttgaaacctgaattttagtgcttcccttattacattcattgttttcaatgattgatttataaaattaagacatactggtagtacaagttgaaagttggtttgaatacattttaattaaatgataatatgttaatatgcttttgttcattgctttctcactgaggtaaaacagcattaaaaagttgtccagaatttaaactga

SEQ ID NO: 172842 - DNA, 7911 bp, Homo sapiens
  Payload ID: 13971
  Gene Symbol: QKI
  Gene Name: QKI, KH domain containing, RNA binding
  Uniprot ID: Q96PU8
  ENST ID: ENST00000392127
  CDS Start-End: 552-1511
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtaagttcttctccccatggggttaacaacattctctttataaatatttttgctccctcagattttgaaatgattttatcagttttagagaggcaagacaagtttgcattagggaagaccgaaaactaaattttgttttatttcagcctctcataagggttcccctttgaaataattgcaccttaaatttattcagatccactttggtaactgaggttcagtttggttgggtaaatctgttgtgtacatttcaacaaatacttttacatttgacattactgaggtcattctgagttttaggtcccaccccattggcccgtcacctccatcagctccacttctcaaactttatttgagatttattttatctcacaggtttgtgtaattgttggaaaatttttaaacttctaagtgaaagtagtctgagcgctttataaaattcatattattgtgtgtgttttgtaatatttgcgatcacttaaaatatcagataaatacagtcatgcatcgcttaacaacggggatacagtctaagaattgccttgtctggcagtttcatcatttggtgtacatcatagagtgtacttacacagacatagatgatatcgtttactacacacctaggctgtgtggtatagccattataatcttatgggaccacatagtataagtggtccgttgttgaccaaaatgttgttatgcaggcatgactgtagttgtattcttaagatttttcagttcttgtgttttggagtcctagtcatattaaacatgagagatactcttaatttcagtagtacagtatggaatagttaaataaatagcaaatcactgaattcagaatctcacttaaggcagaaattaaaatcataatataaacgcttggttttacatgaacaaaaagtggtgtgctcgaaaaagacattactgatgccttttttttatagagtggattgaaatgccagtcatgcctgatatttcagcccattgacttgctggatgaaggactagaatacagcagctgttataacacgaccagtcaatgtggaacaaactgtttctgtgcaacccctttgttttaccagacaaaatttgaatactttttttcctgaattgtatatgaccttggtgctgcatgcatgctgttgacttttaggactttgatcttttaaggttttttttccccagcattaatattgatttataaagatttgaaaatctttaatgaactggagaacactaagatttaaactcgaaaattcgttgttcaagtaaagaaagccatgatgctctgtatgttatctgtgtgtgtgcatgcactcaggtgccctttgtttcatgaacaaatacatttcattgtacatgttttctgtttaaatcattgtataaagtaattgcaggtcagaattataccacagaactgtttatgagaggcttgtgtctgttgcacatttcttgaagcatttttaaaataacatgtaacctgtaaccttgttgtttaagttttcttttctattaatactctgtcctgtggtcccgtgcatgctccttttcccagaactcctctctgctgcacccacagcatctgttcccgaggagttatgactcttgacttcctgcagggctggggctcttagccaccagctgctgttccagcactttcagcgcaagatctccctgattttgccacgtggaattgtacttgtatatgattaccttatctaaaatgaataagaggtgatggaccagtttactgcttagaaatagcaagaggcactgcagtaaaacttgtttctcattgtaaagcttcatgtcttttgtttgttggaaaatttttacttatagaaacttaattattagactggtaaaataaagaccaaaatatgcagatttctaattggcattcataaggtgaataataataagtgcccaatgaaaaaatctattatggttaatttcatttcttgctttgccacctaagcagtaaaacatgatattgaccacttggagaactcagaaaattattttaaatttctaagttataataaatttgcacacagataacatgcatgctatttatgtcacatctcacattaaattattttaaaataagcagtgcccttcaaaacagatgcagacatgtgtgttggtagtagtgaggagattggtattagcatcaagtcttcattgatgactaatttttaattcccttccttttatctttaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaa

SEQ ID NO: 172843 - DNA, 954 bp, Homo sapiens
  Payload ID: 13971
  Gene Symbol: QKI
  Gene Name: QKI, KH domain containing, RNA binding
  Uniprot ID: Q96PU8
  ENST ID: ENST00000424802
  CDS Start-End: 1-954
atggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattagagtggattgaaatgccagtcatgcctgatatttcagcccattga

SEQ ID NO: 172844 - DNA, 5685 bp, Homo sapiens
  Payload ID: 13971
  Gene Symbol: QKI
  Gene Name: QKI, KH domain containing, RNA binding
  Uniprot ID: Q96PU8
  ENST ID: ENST00000453779
  CDS Start-End: 552-1511
tgaactgaggcgaactccgccgccaagtgagtgaggaggaggaggaggagaaggaggaggaggaagaggaggagcgcagtcggagcgcggcggcagcggcagaggcgccgcggcggggaccagcccagagagaccccccgagcccgcggcacaggcggcggcggcgctgagcgggctcgaccagccgagcgagcggcggccccggctcctcctcgtccggcgccagcagcccgcgccccgcgcccgcactcggccagccgagacccgcctcccgcccgcccgccggcctcgtgagggacgcgccgagccgggcggccgagagcggcggcggctgggagcgcgtcgggcccgggcggaaagtgcctgcggggggcgggcgagcgcgcggtgccggccgccccggggctcggcgcgggagccagagcgggagccggcgcggagcgggacgccgggtcccgagcggcccgcggccggggctcgcccccgcccctccctcctctccggcggcggcggcggcggcggcgggcggagtgagctgcggagcctggaatatggtcggggaaatggaaacgaaggagaagccgaagcccaccccagattacctgatgcagctgatgaacgacaagaagctcatgagcagcctgcccaacttctgcgggatcttcaaccacctcgagcggctgctggacgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtatggctttcccaacgaaaggctaagaattcaagaacggtcttaactgaaccctcatcagatctgaatttaacaaatgcttagtctcagcagcctccgggggaaaaaagcttagcctagcagtcagtgacttacttgcactttttgcacatagatataaagtaaaattatgttattaatttggtttagtctgtaatattacacagtaatggtaatttataaaggagtgtatagtagtatactgactgctaagtgtactatactgtttgctttactaatcacctaattcattgcagttcatacttattgactcagagtttaaaaccacaatctgtaggctttaagaattgcttttaaacctttttaagtgataaactcttgaagtggtcttaaggttagcaaataattgtctgtattaaacatggcgttatttaagtagtcctgctgcaagaaaggcacttcagtgaatatgtgactagtaaagcttaaatatgtttggatctaatagagctcatgaaatactgtaacttggggattgtaaatgaatggatacaataggttaaggcccaagatgtttgaaatgaatgcaatattaatagatgcatatatacatgacatattgtggttaattttaaaactactgtgccttaacgtgtttcttaaacttttgtagtaaatgaacatttgaaatccattttgataaacctgctgttaatgttttttccccccttgtgaatgttttctaactttgtcttggtaattgcaatttaactaggtgcggtggctactaaagttcgaaggcacgatatgcgtgtccatccttaccaaaggattgtgaccgcagaccgaggttagtttagttctgcagttcttgtctataagaaatgcgttgggtgtccataaaatttgcaacaccacacctgatggaaaaatgtaattgcttacctgcacacagttttttttccttttctaaatttgtttgtgatcattgacagatttaagggttgggttttttgttttggtttggttttttctcccttcatattttaacttattaaatcttctattattatgtactatgatttattcctactaaaacataaattagtcaatttggggagctattaaattttgatgttgcctcagttattttcattaataacttttgctaaaatttaccttttaaaagttctgaaatttggggttggtattgcaaaatgaattgaacggatggtgctttaatgagagaagtaaaggaatatatgcctcctgtgtacttttggagaaaactgaagatttagtttccatttttctttataataaaatatttgagccactgtataaacatgagggtgcacatgtcaagtacttagctaaaatcaacaaagtgaggactgtgaagataactttcatgtagttggatttttttatataaattagagcgtcaattcccttttattcttacattctcttgccaaaatggatcctttgatttttgtcatttgctgctaaaatatattatctgaaggtaaactgtctcttgaagttctgtggtggtatgagatccagctgtgtgaatataatttttgactaacctgtgactggaaaataagtcttcatttttctcctttacaacttttataatttgtgtcctgtatatgcccttggacccttttataaattatttttgcttattgaggaatggtattttcggtttattgacattgaattgttttctaagtttttccatcacaagataggaatatcaagcatggtagtaaaaaaggattttttacaagtttctattatggcacatttgtttcctacaaattaaattgatcaaagtctcaaatattagtggaggaaaaagtgctggatttgtacttcaattgtacatcttctatgaatttatgaaggacctacctgctttatgtgattaccttgagtactgatgataaatactagacacagctgttgtccacatcagaaataacatgcctttcccaaagacattgttaatatttgtttagcataatccataaagaacgttgaagacttttaaactaatgtattcatcactaacagtgattgttcagtgaacaaaatagaccccagctccgtggtcgtctatgaggatggtattccttgtaagtgttctgtatgagcacgtctcatagggatggggaagttttttggaaagtcacttgagttttaaagaaactggacaattccatgaataatttgaggttttattcatattgctaatgtctacaattgttctaaagagtattttaaagtagtttttttcccccagctaatctttccctatgtatgcccccttttaggagatttctcaccattttgctttaacacaataattattggcctacttaatactccagtgccttgagatagttggacatattttaggaagattttattgtatttggaaaattacgacacattccatgcatggatcttttgtagttacgtgttttgattagtcctgtcactgtttttatttaaaatgcagtgtcagcaaaccgaaatgctcatttcttttttagtaacagagtactcgtatacttatcactgtatgcactcattgggtctaagggagatgtctgaagtccttcacttaaattattttatgatactactgttttctctatttttgaggttaaaattattttaaaaaaatattttgaagagaagtttattagtataagcattcatttaatgcaaaaaaactcagcccttggacatataaccatgtaattctatatgaacgtttagagtactacatggttgaccaatatctagttctttactaaaagtaaactcacctctttatatatatttcaaaactgaatttgaagcctattagagaccaactgaccttttagttgtaatgaactgtatggtcttgcatggtgacacacctgtgtaggaggccaagacttggcagaggatgtagtctaggtgtcctggtatatataaatggtcactcacttcgtttatatattccacactcagaaaagaagtcagagttttttctgagtaatacaaaaaccatcacttacataatttgtataagaaactttaaacagttttaatcaaaactatgagtaacatcaaaaatgctttaagattctatattttggaatacctgtgaagtagtatgactacatcatgttaaatatttattttcttctatgattttggagcagcaatttttattttaaataaaattccacttttaagaaattcagggaagatttggtcacattgaagatacagtatttttgtagtatttataaactgttctaaatgatagactatagaaaacatttttgtcatatgaaggtaaatcagtccattattttggatcatttaaactgaacattacaccttctgggctttgatttatgaagtggcacagaatctaactttgcactgaatatcttttcattcacatctcctctgccttagtcacaatggcaacagtacagaaaattctatcaaacctcagaatatagtagaaataattaagctgttgaatgagtcttaaaaattatactactgttaagtggaccaagtttggtgaagcagaatgtgacaaaggttgattaaggaaggaacaactcaaggacattgggaatgataacttttccacttgagaactactttatgttttactgtaatttttaaagtttttttgtcctttttgttattttgcaaaagaaaatagtatttacaggtggcttcttttaaaatataaaaatataaagcaggaatgtatatgaaatgtcagattttattgtatttgcagagtattagctttgaaattgaataaagaaagctgtttgtagttttaaaatgccttattggtatcaattagaaatttcttctattttttgatgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgtttgtaaatagaataattgaaaaagcaataaacatttattgaacaaaagaaa

SEQ ID NO: 172845 - DNA, 846 bp, Homo sapiens
  Payload ID: 13971
  Gene Symbol: QKI
  Gene Name: QKI, KH domain containing, RNA binding
  ENST ID: ENST00000545607
  CDS Start-End: 1-103
agattacctgatgcagctgatgaacgacaagaagctcatgagcagcctgcccaacttctgcgggatcttcaaccacctcgagcggctgctggacgaagtttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcac

SEQ ID NO: 172846 - DNA, 597 bp, Homo sapiens
  Payload ID: 13971
  Gene Symbol: QKI
  Gene Name: QKI, KH domain containing, RNA binding
  ENST ID: ENST00000544823
  CDS Start-End: 87-597
ttcctctggactagcaagaatattttttttgtctaacacatttaaaatttttacttttaacagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctc

SEQ ID NO: 172847 - DNA, 583 bp, Homo sapiens
  Payload ID: 13971
  Gene Symbol: QKI
  Gene Name: QKI, KH domain containing, RNA binding
  ENST ID: ENST00000537041
  CDS Start-End: 104-583
aaaaattagccgggcatggtagagtgtgcctacagtgccagctacttgggaggctgaagcagaagaatcgcttgaacctgaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccaacagcccag

SEQ ID NO: 172848 - DNA, 457 bp, Homo sapiens
  Payload ID: 13971
  Gene Symbol: QKI
  Gene Name: QKI, KH domain containing, RNA binding
  ENST ID: ENST00000545346
  CDS Start-End: 47-172
agttcatctttggcagtagcatgaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagatttgtgacttcttgccacggtgaactactattaccgactggtgtgttggagcatggcatttgtcttgatcggtgattctcaaaacacagtccttggaccatagtatctacgctttctgggaactgtaaatgttcaagcccctttccatacttattgaatcagaaactctgggtttaattttgttgggagaatccttggacctagaggacttacagccaaacaacttgaagcagaaaccggatgtaaaatcatggtccgaggcaaaggctcaatgagggataaaaaaaaggag

SEQ ID NO: 172849 - DNA, 1106 bp, Homo sapiens
  Payload ID: 13971
  Gene Symbol: QKI
  Gene Name: QKI, KH domain containing, RNA binding
  ENST ID: ENST00000537883
  CDS Start-End: 1-715
agagaaaaggagtgcagaattgcctgatgctgtgggacctattgttcagttacaagagaaactttatgtgcctgtaaaagaatacccagatgaggagcaaaatagaggcaagcccaattgggagcatctaaatgaagatttacatgtactaatcactgtggaagatgctcagaacagagcagaaatcaaattgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagccgccaccggcaactaacctatgaccttctgacctctgaactcttcacccaatgatgacctgaccatgcctgcctgctgatcagttaactggtaatcgcctttgcttgcctgtcgtcagtgcagcgagctgaggcacttgtccgttcgtcttaccatctaaccaaacaaaagacaaagaaattgttgtcctccaactcagctttttttttttttttttcctgtttgggtgaaagtggttctagaaactgcactgaatagtagtaaagcaataaggcccaattcatcccacagcactgatcatcttttaatatcccaccctaagcgaacggtaagaaggcctctcttaagaaggggagacagatggtccttaactactcaatgacagaggcagttactgtgagagactt

SEQ ID NO: 172850 - DNA, 613 bp, Homo sapiens
  Payload ID: 13971
  Gene Symbol: QKI
  Gene Name: QKI, KH domain containing, RNA binding
  ENST ID: ENST00000544361
  CDS Start-End: 1-556
attgaagagagcagttgaagaagtgaagaaattattggtacctgcagcagaaggagaagacagcctgaagaagatgcagctgatggagcttgcgattctgaatggcacctacagagatgccaacattaaatcaccagcccttgccttttctcttgcagcaacagcccaggctgctccaaggatcattactgggcctgcgccggttctcccaccagctgccctgcgtactcctacgccagctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacctagtggtgtattaggtgcggtggctactaaagttcgaaggcacgatatgcgtgtccatccttaccaaaggattgtgaccgcagaccgagtcacaatggcaacagtacagaaaattctatcaaacctcagaatatagtagaaataattaagctgttgaatgagtcttaaaaattatactactgttaagtggacc

SEQ ID NO: 172851 - DNA, 551 bp, Homo sapiens
  Payload ID: 13971
  Gene Symbol: QKI
  Gene Name: QKI, KH domain containing, RNA binding
  ENST ID: ENST00000537124
  CDS Start-End: 409-551
aacctggtaggcggcggttgcagggagaggagattgcgccactgcactccagcctgggtgacagagcgagattccatctcaaaaacaaataaaatttggaaccttttttgtaaactcttcaatgtcatagttttacagggtctcaaacttactttgcagattatatcagagaattgtgttttagagctgcaggggacctgagagttgggagtatatgttcatttcataggtgcaaagacaagtgggcagcagagctagagcaagacactcacttctgccctctgttccattttgtggcgtgcctctccacaaggggaactggagggaaaaacctggaatatttccatatgctaaaaatctgctgctgttgcctcaagttgtgaagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatcct

SEQ ID NO: 172852 - DNA, 495 bp, Homo sapiens
  Payload ID: 13971
  Gene Symbol: QKI
  Gene Name: QKI, KH domain containing, RNA binding
  ENST ID: ENST00000544436
  CDS Start-End: 196-495
agtacctgaagtattaatttctagtagctgtgggtttctgtggacgcctagagaaaaaaaagaccacaaaaaaagtctgtttcgaaaatcgactggccaggagtttgtttgtttttttttcctgcttagaggcaccaccggaggactgtgtaaaggaaactgaaaactacagaaattagcagagtacggaaagacatgtacaatgacacattaaatggcagtacagagaaaaggagtgcagaattgcctgatgctgtgggacctattgttcagttacaagagaaactttatgtgcctgtaaaagaatacccagattttaattttgttgggagaatccttggacctagaggacttacagccaaacaacttgaagcagaaaccggatgtaaaatcatggtccgaggcaaaggctcaatgagggataaaaaaaaggaggagcaaaatagaggcaagcccaattgggagcatctaaatgaagatttacatgtactaatc

SEQ ID NO: 172853 - DNA, 1317 bp, Homo sapiens
  Payload ID: 13972
  Gene Symbol: QTRT1
  Gene Name: queuine tRNA-ribosyltransferase 1
  Uniprot ID: Q9BXR0
  ENST ID: ENST00000250237
  CDS Start-End: 11-1222
gacagtcaagatggcgggagcagctacccaggcttccctggagtcggccccacggatcatgcggctggtggccgaatgcagccgctccagggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttggctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgtaactta

SEQ ID NO: 172854 - DNA, 1502 bp, Homo sapiens
  Payload ID: 13972
  Gene Symbol: QTRT1
  Gene Name: queuine tRNA-ribosyltransferase 1
  Uniprot ID: Q9BXR0
  ENST ID: ENST00000421333
  CDS Start-End: 8-685
agtcaagatggcgggagcagctacccaggcttccctggagtcggccccacggatcatgcggctggtggccgaatgcagccgctccagggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggcccctggggcttgtgactggggccctgttgcaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttgggtatgttgtggatagggaagccagagccctacctgtgggaagtggattcctggggaccccctaccctgcttggggaggtggcatttgggggaaacggacacaggtctgatctgaggagactaggaagacatggctgtcccttgggggccattctgagggaatatggcccagtctggggcagtgtgagggttgggaggggccctgggaagcccctgaggttctctgccccctcccgtcatggctgcaaccccagctatgccactgatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctgcagctcatgagcgccgtccgcaccagcatcgtggagaagcgcttcccggacttcgtgcgggacttcatgggcgccatagtgtgtctgtgtcttcttgaggaagtggcctgtctgggtccccctcccagtctgagcgtcattgcagt

SEQ ID NO: 172855 - DNA, 994 bp, Homo sapiens
  Payload ID: 13972
  Gene Symbol: QTRT1
  Gene Name: queuine tRNA-ribosyltransferase 1
  ENST ID: ENST00000587599
  CDS Start-End: 1-610
gggagcagctacccaggcttccctggagtcggccccacggatcatgcggctggtggccgaatgcagccgctccagggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggacagcggcggtttccagatggtgtcgctggtgtctctgtccgaggtgacggaggagggcgtccgcttccgctccccctacgacggcaatgagaccctgctgagcccggagaaatccgtgcagatccagaatgcgctggccttgctctgtcatccaggctggagtgcagtggcacaatcttggctcactgctacctctgtctcccagattcaagctattctcctgtctctgccttccaagcagctgggaatacaggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaagagatgaccaagcgagacgtgcctggcttcgccatcgggggcctgagcgggggtgagagcaagtcgcagttctggcggatggtggcgctgagcacctctcggctgccgaaggacaagccccgatatctgatgggggttgggtatgttgtggatagggaagccagagccctacctgtgggaagtggattcctggggaccccctaccctgcttggggaggtggcatttgggggaaacgga

SEQ ID NO: 172856 - DNA, 500 bp, Homo sapiens
  Payload ID: 13972
  Gene Symbol: QTRT1
  Gene Name: queuine tRNA-ribosyltransferase 1
  ENST ID: ENST00000592376
  CDS Start-End: 1-411
gatctggtagtctgcgtggctcttggatgtgacatgttcgactgcgtcttccccacacggacagcgcgctttggctctgccctggtgcccactgggaacctgcagttgaggaagaaggtgtttgagaaggacttcggccccatagacccggagtgcacctgccccacgtgccaaaagcacagccgcgccttcctgcacgcactgctgcacagtgacaacacggccgcgctgcaccacctcacggtccacaacatcgcctaccagctcatgagcgccgtccgcaccagcatcgtggagaagcgcttcccggacttcgtgcgggacttcatgggcgccatgtacggggatcccaccctctgtcccacctgggccactgacgctctggcctctgtgggaatcacactgggctgacctggcattgggagagggagggaggaaggaagggagggaggggctggaagatactgaaggattcctttttgaaaggttttttttattgt

SEQ ID NO: 172857 - DNA, 370 bp, Homo sapiens
  Payload ID: 13972
  Gene Symbol: QTRT1
  Gene Name: queuine tRNA-ribosyltransferase 1
  ENST ID: ENST00000591643
  CDS Start-End: 1-370
ggacatcatcatgcagctggacgacgtggttagcagtactgtgactgggccacgtgtggaggaggccatgtacaggtcaatccgctggctggaccggtgcattgcagcccatcagcggccggacaagcagaacctcttcgccattatccagggtgggctggacgcagatctccgggccacctgccttgaaggtcctcagagcgaaagtctaaaatccagaacattggccgggtaccatagctcacacctgaatcccagcactttaggaggccaagagatgaccaagcgagacgtgcctggcttcgccatcgggggcctgagcgggggtgagagcaagtcgcagttctggcggatggtggcgctgagcacc

SEQ ID NO: 172858 - DNA, 539 bp, Homo sapiens
  Payload ID: 13972
  Gene Symbol: QTRT1
  Gene Name: queuine tRNA-ribosyltransferase 1
  ENST ID: ENST00000592254
  CDS Start-End: 1-539
cagctacccaggcttccctggagtcggccccacggatcatgcggctggtggccgaatgcagccgctccagggcccgggcaggcgagctgtggctgccgcatgggacagtggccactcctgtgttcatgccagtgggcacgcaggccaccatgaagggcatcacgaccgaacagctggacgctctgggttgccgcatctgcctgggcaatacctaccatctgggtctaaggccgggacccgagctgatccagaaagccaacggtctccacggcttcatgaattggcctcataatctgctaacggtgacggaggagggcgtccgcttccgctccccctacgacggcaatgagaccctgctgagcccggagaaatccgtgcagatccagaatgcgctgggctcggacatcatcatgcagctggacgacgtggttagcagtactgtgactgggccacgtgtggaggaggccatgtacaggtcaatccgctggctggaccggtgcattgcagcccatcagcggccggacaagcagaacctcttc

SEQ ID NO: 172859 - DNA, 4023 bp, Homo sapiens
  Payload ID: 13973
  Gene Symbol: QTRTD1
  Gene Name: queuine tRNA-ribosyltransferase domain containing 1
  Uniprot ID: Q9H974
  ENST ID: ENST00000281273
  CDS Start-End: 258-1505
agtactccctgattggctctgcactggaggcagtgattttggggcagagaattttgcaacacgtggtagtgaactgtgaggagtttgaggggtctgaagactgaaagagtcgaatggtttgttggcagggtgtcctggtggattggtttctgtaagttcagattctcataaatcgtgtgagcgtcgccgacacctctgagataaaagggcccctttcgactagcctctgctgaaaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccagtcagcccctgcccggctggttatgtaacaaacaagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacactactacaacaaaatggaacacaagaagaaataaaatgtatggatcaaataaagaaaattgaaacaactggttgcaaccaagaaataacatcatttgaaattaatctgaaggaaaaaaagtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaagaaataatctgagctttaattatttatatttggatataaggtctgcttaaataaagaatctttgtaccaaactgcccacatgagggtgaagagatttcctcaaaagacttaaatgacctggattgatcagagagaattgaactgtgacctttaagacttctagactaattcttttagttgatagagattcatttagtcaaagacaaaagctttaactgtgagggcacagccttgaagtgggagtgatgagattctgagggacccatgaattggattgaggcttgaggggaaatggtgtgagacgaatgggctctggacatatgcctgttgatttgagaagaaatctggctggtttgagggtttcctttagttcaccctcatactctcaggagactcttctggatacttttgtcttccaccctgccctggcagtgcagccaatcagaaatggctcttgtgacttaactgggcttggatatccctggaatgtggggcttgaacattgctcctgtgatgatcatctgtcccaggtcacactccttcatttgaccacatggcctatttgcaacttctttttagagccaatgtaattgcctgttaggagccagaagtttgcccagctgctttcttctggttgtacagatccattgtggtctgccttccaggctcattaatagtctaactacgtaataactgaagacctatctcttgtgaagattcattctcaatgtgttcacttggacagagccctgcctggcctaacgattagagggttagtctccatcctgctcagatatgactcctgggcaattcacttaacttctccatggctgcttcctgctgaataaatagggacaggcataatggataggaatgaatgaacttttaagatactgtctagctctaaaattggaagaacaaaaagttttagattagagtcatagccttaatagccctagttgtcatcctgggagacaggcaacagtagagatatttgagagcctaaagagaggtttggcctgtgggtttttaagtggttattgaattggtatcaggagatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctatgcaacctccacctcctgggttcatgccattctcctgcctcagcctcccgagtagctgggactacaggcgcccgccaccatgcctggctaattttttatatttttagtagagatggggtttcaccgtatgagccaggatggtctcgatctcctgacctcatgatccacaagactgggtaatctgtaaagaaaagaggtttaattggctcatggctctgcaggctttacaggaagcatggtactggcatctgcttggtttctggggaggcctccggaagcttatagtcatgacagaaggtgaagggggagcaggcacatcacatgacaaaagcaggaacaagactcagagcaagaagtcacttatcaccaaggggatggcccaggccattcatgagggatccacctttgtgctccaaacacctcccaccaggccccacctccagtattggggattacatttcaacttgaggtttgggcgggaacaaatagtcaaattatattacccatctacatggttttctttttcttagtatgggagtgtccatgaataaattcatgggcatcctcataactcttccatgaatggcaaggggtacttatggaaaacagttttccaaagatctgattgttttgaaatgtgttagattggacttgttcaaatgttcatatttttgttctatgctaaatgcatcgttaggggagtagtggtaaatattccagaatccatatgaaattcatgagtttatttatgtctaaaacactgaaaactgtgtccaatatcgttcagtttcctgggtctttttcttattagcacatttgagaaaaatattcctttcctttattgtagtaaatctattaaaggcaatagccaataaaacatttttaattttaaaaatttactgtgtttggctttctgtaaatgtagtaggtctgttaaacaaaatattaaatttccatagtaccagaaa

SEQ ID NO: 172860 - DNA, 1196 bp, Homo sapiens
  Payload ID: 13973
  Gene Symbol: QTRTD1
  Gene Name: queuine tRNA-ribosyltransferase domain containing 1
  Uniprot ID: Q9H974
  ENST ID: ENST00000479882
  CDS Start-End: 243-1121
gcactggaggcagtgattttggggcagagaattttgcaacacgtggtagtgaactgtgaggagtttgaggggtctgaagactgaaagagtcgaatggtttgttggcaggacctagaagaatcccttaggatgaagctgagtcttaccaagagcagaacatcatgaagtcttgacagaatataaagaaggagttggaaagtttatagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacactactacaacaaaatggaacacaagaagaaataaaatgtatggatcaaataaagaaaattgaaacaactggttgcaaccaagaaataacatcatttgaaattaatctgaaggaaaaaaagtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaaga

SEQ ID NO: 172861 - DNA, 881 bp, Homo sapiens
  Payload ID: 13973
  Gene Symbol: QTRTD1
  Gene Name: queuine tRNA-ribosyltransferase domain containing 1
  ENST ID: ENST00000462966
  CDS Start-End: 1-30
tttgaaattaatctgaaggaaaaaaaatgaatttgtagacttcgtcttgtcagaagactggagccaggtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaagaaataatctgagctttaattatttatatttggatataaggtctgcttaaataaagaatctttgtaccaaactgcccacatgagggtgaagagatttcctcaaaagacttaaatgacctggattgatcagagagaattgaactgtgacctttaagacttctagactaattcttttagttgatagagattcatttagtcaaagacaaaagctttaactgtgagggcacagccttgaagtgggagtgatgagattctgagggacccatgaattggattgaggcttgaggggaaatggtgtgagacgaatgggctctggacatatgcctgttgatttgagaagaaatctggctggtttgagggtttcctttagttcaccctcatactctcaggagactcttctggatacttttgtcttccaccctgccctggcagtgcagccaatcagaaatggctcttgtgacttaactgggcttggatatccctggaatgtggggcttgaacattgctcc

SEQ ID NO: 172862 - DNA, 1046 bp, Homo sapiens
  Payload ID: 13973
  Gene Symbol: QTRTD1
  Gene Name: queuine tRNA-ribosyltransferase domain containing 1
  Uniprot ID: Q9H974
  ENST ID: ENST00000493014
  CDS Start-End: 69-998
agagaattttgcaacacgtggtagtgaactgtgaggagtttgaggggtctgaagactgaaagagtcgaatggtttgttggcagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacactactacaacaaaatggaacacaagaagaaataaaatgtatggatcaaataaagaaaattgaaacaactggttgcaaccaagaaataacatcatttgaaattaatctgaaggaaaaaaagtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactg

SEQ ID NO: 172863 - DNA, 449 bp, Homo sapiens
  Payload ID: 13973
  Gene Symbol: QTRTD1
  Gene Name: queuine tRNA-ribosyltransferase domain containing 1
  ENST ID: ENST00000482307
  CDS Start-End: 15-449
aagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccagtcagcccctgcccggctggttatgtaacaaacaaggttcttcagaagagtgtgatcattggagtgattgaaggtggagatgtgatggaagagaggctgaggtcagcacgagagacagccaagcggcctgtgggtggc

SEQ ID NO: 172864 - DNA, 3844 bp, Homo sapiens
  Payload ID: 13973
  Gene Symbol: QTRTD1
  Gene Name: queuine tRNA-ribosyltransferase domain containing 1
  Uniprot ID: Q9H974
  ENST ID: ENST00000485050
  CDS Start-End: 116-1399
gcagtactccctgattggctctgcactggaggcagtgattttggggcagagaattttgcaacacgtggtagtgaactgtgaggagtttgaggggtctgaagactgaaagagtcgaatggtttgttggcaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccagtcagcccctgcccggctggttatgtaacaaacaagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacactactacaacaaaatggaacacaagaagaaataaaatgtatggatcaaataaagaaaattgaaacaactggttgcaaccaagaaataacatcatttgaaattaatctgaaggaaaaaaagtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaagaaataatctgagctttaattatttatatttggatataaggtctgcttaaataaagaatctttgtaccaaactgcccacatgagggtgaagagatttcctcaaaagacttaaatgacctggattgatcagagagaattgaactgtgacctttaagacttctagactaattcttttagttgatagagattcatttagtcaaagacaaaagctttaactgtgagggcacagccttgaagtgggagtgatgagattctgagggacccatgaattggattgaggcttgaggggaaatggtgtgagacgaatgggctctggacatatgcctgttgatttgagaagaaatctggctggtttgagggtttcctttagttcaccctcatactctcaggagactcttctggatacttttgtcttccaccctgccctggcagtgcagccaatcagaaatggctcttgtgacttaactgggcttggatatccctggaatgtggggcttgaacattgctcctgtgatgatcatctgtcccaggtcacactccttcatttgaccacatggcctatttgcaacttctttttagagccaatgtaattgcctgttaggagccagaagtttgcccagctgctttcttctggttgtacagatccattgtggtctgccttccaggctcattaatagtctaactacgtaataactgaagacctatctcttgtgaagattcattctcaatgtgttcacttggacagagccctgcctggcctaacgattagagggttagtctccatcctgctcagatatgactcctgggcaattcacttaacttctccatggctgcttcctgctgaataaatagggacaggcataatggataggaatgaatgaacttttaagatactgtctagctctaaaattggaagaacaaaaagttttagattagagtcatagccttaatagccctagttgtcatcctgggagacaggcaacagtagagatatttgagagcctaaagagaggtttggcctgtgggtttttaagtggttattgaattggtatcaggagatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctatgcaacctccacctcctgggttcatgccattctcctgcctcagcctcccgagtagctgggactacaggcgcccgccaccatgcctggctaattttttatatttttagtagagatggggtttcaccgtatgagccaggatggtctcgatctcctgacctcatgatccacaagactgggtaatctgtaaagaaaagaggtttaattggctcatggctctgcaggctttacaggaagcatggtactggcatctgcttggtttctggggaggcctccggaagcttatagtcatgacagaaggtgaagggggagcaggcacatcacatgacaaaagcaggaacaagactcagagcaagaagtcacttatcaccaaggggatggcccaggccattcatgagggatccacctttgtgctccaaacacctcccaccaggccccacctccagtattggggattacatttcaacttgaggtttgggcgggaacaaatagtcaaattatattacccatctacatggttttctttttcttagtatgggagtgtccatgaataaattcatgggcatcctcataactcttccatgaatggcaaggggtacttatggaaaacagttttccaaagatctgattgttttgaaatgtgttagattggacttgttcaaatgttcatatttttgttctatgctaaatgcatcgttaggggagtagtggtaaatattccagaatccatatgaaattcatgagtttatttatgtctaaaacactgaaaactgtgtccaatatcgttcagtttcctgggtctttttcttattagcacatttgagaaaaatattcctttcctttattgtagtaaatctattaaaggcaatagccaataaaacatttttaattttaaaaa

SEQ ID NO: 172865 - DNA, 680 bp, Homo sapiens
  Payload ID: 13973
  Gene Symbol: QTRTD1
  Gene Name: queuine tRNA-ribosyltransferase domain containing 1
  ENST ID: ENST00000472599
  CDS Start-End: 180-680
gtgcactcagagagacattctgaagggaaccctgcaagttgcctgttgttgttcttcccaggggaggactgagcatacaaccactgcttcccaagggaggcttttcccacaaagggggcacagcagtctcctgagagagagaaacatgttatagctcaactatttaaaggactgtgctgatgaaatccaacatttatgaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccagtcagcccctgcccggctggttatgtaacaaacaagtctgtgtctgtgtggagtgttgcaggacgagtggaaatgactgtttccaagttcatggcaattcagaaggcccttcagccagactggttccagtgcctctccgatggagaagtatcttgtaaggaa

SEQ ID NO: 172866 - DNA, 2519 bp, Homo sapiens
  Payload ID: 13974
  Gene Symbol: QSOX1
  Gene Name: quiescin Q6 sulfhydryl oxidase 1
  Uniprot ID: O00391
  ENST ID: ENST00000367600
  CDS Start-End: 12-1826
cagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacactgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaa

SEQ ID NO: 172867 - DNA, 9311 bp, Homo sapiens
  Payload ID: 13974
  Gene Symbol: QSOX1
  Gene Name: quiescin Q6 sulfhydryl oxidase 1
  Uniprot ID: O00391
  ENST ID: ENST00000367602
  CDS Start-End: 75-2318
gaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacactgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggcaagcattggtgtgttctttaacttgctacttggagacctagtgtccagtctggacagaatgcacagagaccagcctcacctggaatgcagccagactcgatgtccctcagcacacacagctcctggccacagactgcccatagaactgtctgcacccaaaccccatggccttttcatgcacggagacaggcctctggatgtgcagccttgccaccccctgccccaatcctccctgagagctcctgcctcagtgccctgggctggtgagggagaagcctgtctgcacctgcctaattccagctcctccaggaagcaagggcttgtttgtcagagctgcagggttggccactcggtggggaggagtcagccaggattagagagcctgcccctaatccggcctgctgggttttacaaggatcagagctgctgataatgaacctcattaagggggagcaggagcctcaatccgatttggttttctctttgacatcttcactctgctcagatggcctgggtgctatgtggagcaggtgggatgccaaggccactcctgctatggggcagctggggctggggagggatggcagtctccctgcatgtttccctcgacctctttagctgcagcgccttgctgggctcctgggttggactccctctctgtgcccctgctccaggcacccattggctccatcctcctggttgtgctctgcaccccctgctcccttgggctggccctggctgggggcctgagagacagacaggaacccacaatcaggaggcaaccctggcctgcaagaggaagacagaggctcccagggccggtgccctgtgtgcccactgcaccaaggccgctgaataagcctgcccttcaccccctaagggctccttgcccaatgccaagtgctggggatttctgtcagcaagccctgtggctccagtgacggtatttctaaagccaaacttagttacctagaattagcgccatgttggaaacactgtcgcagcagcccgggctgcacagtgtgtagcccagcctccaggtccacggagtggtgtggacctcccacctcacagctgcctctggcagccaagcctcttttcgcccggccccagcccctctggttgataaacgggtgggcctcctcagcagcgtggctgcctttcaccttgatttccccagggctctcggcaacatcgataaaccagcctcgcccaccagctgggccctcccccacccagtctgccaggctgggagctggagcttgctgagtcttgaatgcccttctagatggcttctctagaggctctcctggcaagagagggtcccaaggggagccctgcaaagcaaaggctccttgtctggggcgggatagagaatctcgcctctgtctggtgtgttacctactgggggcacaggaacaatttcctcaaggagacagtggcatggagctttgaaagacgagtaggtgttagcaaggaaataaggaggaacgggggttacgggcagaggagaaagcacatgccaagtcagcaaagaaaagtagaattcgaaaactttttaaaaatattactaaggattttcacaatgctgcactgggctagaaactgaagctaaaacagatacgtggtccctgctgctatggggcttccgttctagaggcaaggacaggttgtgatgagggttctgaaggatagagaccaagcagggagggtgttgaggaggcttctgcgagacctgaaggatgggaagccaggaagtgggaggggtgggggtccaggctggaggggcccaatgtaggtgtagagggactacagccctgaggggctgctccatgcggcattcttggaggtccaagaggggcagcgccaccttgggccaggctcctctccagcagccttggtatggggtgggggtgggaagacccctgatgcagcctgtcctctgggtgtgggggtggaggagagggctccaggggacccagccagccttgaccctggaggaaagtcaggtgggctcagagagagccctcaaatctgggccctgggtcagggtggggtcaagtccagccttgaagagaatggactctggaatctgacgtctgggtttgaatccagcttccaacactcactggctgtgtgactttgggcaagataacttatccccttgtccccatgtgtcattggagataaactacccacctaccagattgttgtaccatgctgggcaaacactaagtgcttaataatggtagcccactgctcatgtcgtgtcgtctcctgtcttgatacctgaaaactcaaggggccctgttgtgcttggaggggggtgccgttcccacaggatattctgtgaagggtgtccctggagctgggcctccaggtggcaagccccaagccaccccggcaggtgccactggccagagttgaactgaggtgttgagtggaaagtgcctccccacccccatctgccacagtagtatggatttccttcatgagatggggctcctaaaatgcctgaaatgtgtatgctgttggagaattgatgtgtatgatttattgaactttgcactcatttaaatctcatttaatcctccaacaacgcaagatgaagaagctgaggcttaaagagattaagaaacatcctatcccctttactcccaccaaaataaatacatttgccctattctcccaaatggtgagaggtagatccaggacttgaccccagatcccacccactcaaccctggagctgcagtctctaccccttctaacacatgtgattctgtttcatgtcctgttccatcggtagagttacacactttcctgagactttatatggtggtgctgctgggtgccagcccttcttccctccaacagtggcagtaaccactgttgtgtgttggtgtcaaggagtggggacaccctgaaggaatccgccttttctagagctctcgctccattccctacatcgaggctgaagtgccctgtctcgggtccttgtttttaggcctcgtttgaaggaggggaagaaaccaggttcgttgggcgtgaccttggctcagctcgtctgtgaaattggggccgcagacttagtttgcgggtccctgctaaattcctctccctcttcctgggattcccatccatgtattgccagctacatgtagagtggagaggagaggtttttcctgcagggccttccagagaaaggattcttggccagaggaaatcacagcctataagatcaatatcctgatagaatcccgggccaggtgtgagaggggagagctcactcacaccagcctgacagtcttggggcagagcgccccataggcctctgcagccccatcactgcctcattctccctcaggtgccaaggaagctccagggtgggcccagtatccttccacagcatccctcctcttccccttcaacacccctttcacccctccctccaccacctctgaaaggtgctccttgggcagggcgataggattcccacccctagctttaagaactaaaccaaacttcaagaggagcaatttaatcttcatacctgactccttgtccctcctcaggcatgctgttgtgcaggacagagccctggcttctcctggatgtcacacctggcctgtctctgacccttgctttccctttctctgctgccctcaagggtcattcacacccaagagggtaagaagctgccctctcatcccttcctctcccaccctgggcctctgccctctgcctggccccagcagcacagtcttctccatagagaggggctgggccatgggaccccagttcctggggtctcggtgacacagttcactgtttgctgcagaggaggccccactcgcagccttggcctctgccctgcagaagaattccctgtaactcactcaccaatggccgtgggagccagtggcctcggcgagggtcagttggactgcatagctgccggctgagtctctctggccaccctcactggccccatcactccaggttgcactgctgcccagggggtttgtgccaggcctgggtcacagtggaagagagtctggaaatcacaaggcagaggaggagacctttgccaatgtgagagaacaaagttaaggggcagtccatgggggcattgaccttacttaggtgaggaggactcagggaacatctacagactctagggctagggtgagatcctcctgatagtgctggtagctccagctgctgctttggcaagacttggtcgtctctatactgagagagcaaaagctcttttcctggggctgcatgttcttccataggaaagtgggcttcaggtgctgcctattaaacctcctgcctcccctgctgcagtgctttgatgcctttcacctgtgtctacctgcgaacctctgcccaccacggaagagcagctcacatttggaaggggctaaaatttttacctagtttgaatctgctctgcaatgtccccatcaagttcttaaccatcccgggttccaatggttacagagttctgccctggggagggaggaattgcttagcaaatgatgttgagaatagtgattatttgggggaaaattcaggtaagatctcaccttcataccatataccaaaatacatctcagtagattagtaagctaatgcaaaaaaaaaaaaaaaaggggaaatataattgaatacttcactgtttttgaaagcatgaaaacaatggaaaatgcaactgatgtgagtaatccatctacttgacgtcacttttaagaaataaggccaggcacggtggctcacgcttgtaatcctagcactttgggaggccgaggtgggtggatcacgaggtcaggagtttgagaccagcttggccaacatggtgaaacccccatctctactaaaatattacacaggcattgtggcacacatctgtaatcccagctactcaggaggctgaggcaggagaatcacttgaacctgggaggtggaggttgcagtgagctgagatcgcgccattgcactccagcctgggggacagagcgagactctgtctcaaaaaaataaaaaaataaaaataaaaaaataaagtaaagctacatatttaaaagctggggaaatatatgctgtaaatatgacaaagggctgtgactcttctgcaacacaccattttaagaatgagctaggtctgcatttattgacctgataaaatgtcccaagaaggacacatttttataaacataagttactattgttatatatatgctaacgtttgtctagaaaaagtctagaaaaatacacactgaactgtgaatagcagttatatttagaaagcaacattaggatgaacttaagtcagggcttggactagagcaaggcaagtgaggtgccaggatgcaaaagttaaggagacacctgacctcaggggcccacaactgcagagcccctgacagtgagtgtctcagtagcctcgccctagtcctggctttcacttaaatatgttttcgaatgtttgtaataaaatatttcttttggaaggcaaaaatagcaaggaaaataaataggattaaaggatactaaagcccattcaataaaatttgtaggaggccactgatttggcctaggctcctatgatgtaaccaacagaccaaaccaatatggagtcattcatgctaaatgaaactagttaggagtatattcatataacaagtggctaagtgtcagttacagcctctgagctttagtcaattgtaggtggtcaatagattcagataaggcaatccagttaaactgtatatcccacttgctgttttctgtccctaaattctctctgagtacactgcagccctgaagttctttgaacctgttctgggttctgagggctgtccaattactgaatcatacataaaagccaagtaagattttaaaatttgttataattttggtttttaacaacttctgttgtaaataataaaagcactaaatccctactgaaaataaagggcctaaagactgaa

SEQ ID NO: 172868 - DNA, 1075 bp, Homo sapiens
  Payload ID: 13974
  Gene Symbol: QSOX1
  Gene Name: quiescin Q6 sulfhydryl oxidase 1
  ENST ID: ENST00000392029
  CDS Start-End: 39-506
tccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccaggctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagag

SEQ ID NO: 172869 - DNA, 893 bp, Homo sapiens
  Payload ID: 13974
  Gene Symbol: QSOX1
  Gene Name: quiescin Q6 sulfhydryl oxidase 1
  ENST ID: ENST00000443059
  CDS Start-End: 1-218
ggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaa

SEQ ID NO: 172870 - DNA, 4530 bp, Homo sapiens
  Payload ID: 13975
  Gene Symbol: QSOX2
  Gene Name: quiescin Q6 sulfhydryl oxidase 2
  Uniprot ID: Q6ZRP7
  ENST ID: ENST00000358701
  CDS Start-End: 39-2135
ccagggtgaaagttcagcgcgccggcggcacttccaacatggcggcggccggggcggcggtggcgcgcagcccgggaatcggagcgggacctgcgctgagagcccggcgctcgcccccgccgcgggccgcacggctgccgcggctgctagtgctgctagcggcggcggcggtggggccgggcgcgggcggtgcggcgcggctgtaccgcgcgggcgaggacgccgtgtgggtgctggacagcggcagcgtgcgcggggccaccgccaacagctcggccgcgtggctcgtgcagttctactcgtcgtggtgtggccactgcatcggctacgcgcccacttggcgggccctggctggggatgtgcgagactgggccagtgccattcgcgtcgcagctctggactgcatggaagagaagaaccaggccgtgtgccatgactacgacatccacttctaccccaccttccggtattttaaagcatttacaaaggagtttacaactggagaaaattttaaaggacctgaccgagagctgcgaacagtcagacagacgatgattgacttcctgcagaaccacacggaaggaagccggccccctgcctgcccgcgcctagaccccattcagcccagtgatgttctttcccttcttgacaaccgtggcagccattacgtggctattgtctttgaaagcaacagctcctaccttggacgggaggtgatcttagacctgatcccgtatgaaagcatcgtggtgacccgagcactggacggggacaaagcatttctggagaaacttggtgtttcttcagtcccttcgtgttacctgatctacccaaatgggtcgcatggattgattaacgtcgtgaagcctctgcgggccttcttttcgtcttatttgaagtcattgccggatgtgaggaaaaaatcgcttcccttgcctgaaaagccacacaaagaagaaaattcagaaatcgtggtttggagagaatttgacaagtcgaagctgtacacggtggacctggagtcagggctacactacctcctgcgggtggagctggcagcccacaagtccctggccggagcagagctgaagacgctcaaggactttgtgactgtcttggccaagctgttccctggacggccgccagtcaagaagctgttggagatgctgcaggagtggctggccagccttcccctggacaggatcccctacaacgccgtgcttgacctggtcaacaacaagatgcggatttctggaatattccttactaatcacataaagtgggttggatgtcaaggaagccgatctgagttgaggggttacccgtgttctctctggaaactgttccacactttgactgttgaagcctcgacccacccagatgcactggttggcacaggctttgaagacgacccccaggctgtgctgcagacaatgaggaggtacgttcacaccttctttgggtgtaaggaatgtggtgagcactttgaggaaatggctaaagaatccatggactcggtgaaaaccccagaccaagccatcctctggctgtggaagaagcataatatggtgaacggccgcctggcaggccatctgagtgaggatccccggtttccaaagcttcagtggcccactccggacctctgcccagcctgccatgaggaaattaagggcctggccagctgggatgaaggccacgtgctcacattcttgaagcagcactatggccgcgacaacctcttagacacgtattccgcagaccagggggattccagtgaaggaggaaccctggccaggggtgaggaagaggagaaaagactcactcccccagaggtgtcccatggagaccgagacacccagagcgtccgtccacctggtgcactgggccccaggcctgcccttccagagagcttgcatcacagcttggacgggaaactccagagtctggatgggcccggggcccacaaggaggtgggcggggccgcacccttcctcggggttgacttctccagcctggacatgagtctctgtgtcgtgctgtacgtggcttcatccctgttcctcatggtgatgtacttcttcttccgggtgaggtccaggcggtggaaggtcaagcaccaccacccggccgtgtgagtgcccgggtgctgccagccacggcggaagctcccttggaggcagccctgccccgtgccacctgcagctttaatatttatgatcagggattttataaacatgcgggcctggtttcacatcggatggcaccttttggcttcaaagtcctggttttacaaacgctcttctaacaagggaagaacacggggtaattttgtggggatatttgcattcctggcgtactcaagtctgttcatgctccttttgcaggtcttacagcaaaaagacttctgtatttttactcttctagatgtgaaaagagggtgcagagtccaggccagatagtcttccccacacactttcatctcgtttcctccactccgccccatcctgcagggccttgtttttgtatttggagaacctcgcccatcccccccgcggctcctggctcccccccactcccctcgctccccctccccccgctccccccacgccccctgctccaggctgccaagtgttttcctttagccgggcggggacagacagagccggaagcgcagtcggcctctgcagcccctccaagcaagtgctccagggactatcctgtgtttgtagctgcttccctagggcaggttcctgagggctctccttgttcctccgggtgttcgacaccagacgtggggatttcaacaggggaggagccaaggaattctgtggctgtgctgcgtttcagaaaataacccccagaggccttgggctgtggacctgggggttggaaggatgggggctcatttaaccctcagaggcagcgcctttgtctgtctatctggtgacaagagagagacaagtaaatgggggccgttgggacggcgggtgcctggagggcagctctgggctcagcgggcagtgcttagagcacaggcccctctgttgggggatggggaggagagcagtctgcccttgggagcgtaggccccagggagacttctaaagccccccctgtcgtctgctcttcacccagcaccacagaggcacctgctgcacacacaagcatctcactcggcccacggagggggccaggcttcctttgcctgaagctgttttgggaagggtctccacacaggcactgatctcccaagcttttgtcatgatgtcttttaccatttgataattttaaacattgtttttaaacccaaaacatttagtggtccgttgcctctgaagatgtaaacaaacaaatacactatttctgggaacatttatattgagattctttgtggctattggtgtgtctcacaggcaaaatttgatttggctaaaataggctcagatgtatttgtgtgcccgtgtgtgtgtgtgtgtgtgtgtgtgtgtgtgtgtgtgtatgagagagagagagactttgacggttgtagatattttttccgctttgcctactttatgttgtataatcatgtgtttactaacaagttgatgacatggatgtattcataagaccatgtaatattgatgtgattgttgtcgcttgagaaaaaaaggcaacagctgattctttcaacaactgtcacagaatggctgggctgagaacgctgcccagggccctgcagctggcgggagaggtgtctggtgggagcggtgtctggtgcgtcagcctgctgcttcgtgtctcactcgagagttgcttctggtttcacactttttaacccctctgtgctttagcagccgtgaccttgccttcattgcttcatccagtgcaggcctgggttattgaagacaccaaagtgtttctcttccagtttgaaaaccaggcaggtttacacgtgggtttcagtgtatttgcctttgaacccttcaaactaaactttagccttttggctggtgttgaatgtctttagctggggtgacctggagtgacctgggacggtgttgtggtttaccgtctccagcttcagcctttccagaaacccttgtggagggcagtgttggctgcaggtttcatcatattgcagtttgaggtcaccactatttggggaacaagcttgcgtcctgctgaggggcaggattttcagcagagcgtcggtggggctgggccgtcgtggaggtggccccaggagtcatatggccatactcagacacaccttgtgtggcctgctcagagctggatgccacctttaggcaatgtttagagtctattttctaaagttttaagtattttaagaggtattgagactaatgaatataatagttcagtaatttaaatgcttatttattttcagtggaaggatttttattaaaaagaagctaattgacatggaaatgtcagtgaaatttcttacctgcaaggaaagtgaacattttgtatttaagtaaactataatgtgcacattttaataaagaaatctgacatttgaaaaaa

SEQ ID NO: 172871 - DNA, 851 bp, Homo sapiens
  Payload ID: 13975
  Gene Symbol: QSOX2
  Gene Name: quiescin Q6 sulfhydryl oxidase 2
  ENST ID: ENST00000455222
  CDS Start-End: 1-851
tggagaaaattttaaaggacctgaccgagagctgcgaacagtcagacagacgatgattgacttcctgcagaaccacacggaaggaagccggccccctgcctgcccgcgcctagaccccattcacgtgaagcctctgcgggccttcttttcgtcttatttgaagtcattgccggatgtgaggaaaaaatcgcttcccttgcctgaaaagccacacaaagaagaaaattcagaaatcgtggtttggagagaatttgacaagtcgaagctgtacacggtggacctggagtcagggctacactacctcctgcgggtggagctggcagcccacaagtccctggccggagcagagctgaagacgctcaaggactttgtgactgtcttggccaagctgttccctggacggccgccagtcaagaagctgttggagatgctgcaggagtggctggccagccttcccctggacaggatcccctacaacgccgtgcttgacctggtcaacaacaagatgcggatttctggaatattccttactaatcacataaagtgggttggatgtcaaggaagccgatctgagttgaggggttacccgtgttctctctggaaactgttccacactttgactgttgaagcctcgacccacccagatgcactggttggcacaggctttgaagacgacccccaggctgtgctgcagacaatgaggaggtacgttcacaccttctttgggtgtaaggaatgtggtgagcactttgaggaaatggctaaagaatccatggactcggtgaaaaccccagaccaagccatcctctggctgtggaagaagcataatatggtgaacggccgcctggcag

SEQ ID NO: 172872 - DNA, 4518 bp, Homo sapiens
  Payload ID: 13975
  Gene Symbol: QSOX2
  Gene Name: quiescin Q6 sulfhydryl oxidase 2
  ENST ID: ENST00000616829
  CDS Start-End: 39-2129
ccagggtgaaagttcagcgcgccggcggcacttccaacatggcggcggccggggcggcggtggcgcgcagcccgggaatcggagcgggacctgcgctgagagcccggcgctcgcccccgccgcgggccgcacggctgccgcggctgctagtgctgctagcggcggcggcggtggggccgggcgcgggcggtgcggcgcggctgtaccgcgcgggcgaggacgccgtgtgggtgctggacagcggcagcgtgcgcggggccaccgccaacagctcggccgcgtggctcgtgcagttctactcgtcgtggtgtggccactgcatcggctacgcgcccacttggcgggccctggctggggatgtgcgagactgggccagtgccattcgcgtcgcagctctggactgcatggaagagaagaaccaggccgtgtgccatgactacgacatccacttctaccccaccttccggtattttaaagcatttacaaaggagtttacaactggagaaaattttaaaggacctgaccgagagctgcgaacagtcagacagacgatgattgacttcctgcagaaccacacggaaggaagccggccccctgcctgcccgcgcctagaccccattcagcccagtgatgttctttcccttcttgacaaccgtggcagccattacgtggctattgtctttgaaagcaacagctcctaccttggacgggaggtgatcttagacctgatcccgtatgaaagcatcgtggtgacccgagcactggacggggacaaagcatttctggagaaacttggtgtttcttcagtcccttcgtgttacctgatctacccaaatgggtcgcatggattgattaacgtcgtgaagcctctgcgggccttcttttcgtcttatttgaagtcattgccggatgtgaggaaaaaatcgcttcccttgcctgaaaagccacacaaagaagaaaattcagaaatcgtggtttggagagaatttgacaagtcgaagctgtacacggtggacctggagtcagggctacactacctcctgcgggtggagctggcagcccacaagtccctggccggagcagagctgaagacgctcaaggacttttgtcttggccaagctgttccctggacggccgccgtcaagaagctgttggagatgctgcaggagtggctggccagccttcccctggacaggatcccctacaacgccgtgcttgacctggtcaacaacaagatgcggatttctggaatattccttactaatcacataaagtgggttggatgtcaaggaagccgatctgagttgaggggttacccgtgttctctctggaaactgttccacactttgactgttgaagcctcgacccacccagatgcactggttggcacaggctttgaagacgacccccaggctgtgctgcagacaatgaggaggtacgttcacaccttctttgggtgtaaggaatgtggtgagcactttgaggaaatggctaaagaatccatggactcggtgaaaaccccagaccaagccatcctctggctgtggaagaagcataatatggtgaacggccgcctggcaggccatctgagtgaggatccccggtttccaaagcttcagtggcccactccggacctctgcccagcctgccatgaggaaattaagggcctggccagctgggatgaaggccacgtgctcacattcttgaagcagcactatggccgcgacaacctcttagacacgtattccgcagaccagggggattccagtgaaggaggaaccctggccaggggtgaggaagaggagaaaagactcactcccccagaggtgtcccatggagaccgagacacccagagcgtccgtccacctggtgcactgggccccaggcctgcccttccagagagcttgcatcacagcttggacgggaaactccagagtctggatgggcccggggcccacaaggaggtgggcggggccgcacccttcctcggggttgacttctccagcctggacatgagtctctgtgtcgtgctgtacgtggcttcatccctgttcctcatggtgatgtacttcttcttccgggtgaggtccaggcggtggaaggtcaagcaccaccacccggccgtgtgagtgcccgggtgctgccagccacggcggaagctcccttggaggcagccctgccccgtgccacctgcagctttaatatttatgatcagggattttataaacatgcgggcctggtttcacatcggatggcaccttttggcttcaaagtcctggttttacaaacgctcttctaacaagggaagaacacggggtaattttgtggggatatttgcattcctggcgtactcaagtctgttcatgctccttttgcaggtcttacagcaaaaagacttctgtatttttactcttctagatgtgaaaagagggtgcagagtccaggccagatagtcttccccacacactttcatctcgtttcctccactccgccccatcctgcagggccttgtttttgtatttggagaacctcgcccatcccccccgcggctcctggctcccccccactcccctcgctccccctccccccgctccccccacgccccctgctccaggctgccaagtgttttcctttagccgggcggggacagacagagccggaagcgcagtcggcctctgcagcccctccaagcaagtgctccagggactatcctgtgtttgtagctgcttccctagggcaggttcctgagggctctccttgttcctccgggtgttcgacaccagacgtggggatttcaacaggggaggagccaaggaattctgtggctgtgctgcgtttcagaaaataacccccagaggccttgggctgtggacctgggggttggaaggatgggggctcatttaaccctcagaggcagcgcctttgtctgtctatctggtgacaagagagagacaagtaaatgggggccgttgggacggcgggtgcctggagggcagctctgggctcagcgggcagtgcttagagcacaggcccctctgttgggggatggggaggagagcagtctgcccttgggagcgtaggccccagggagacttctaaagccccccctgtcgtctgctcttcacccagcaccacagaggcacctgctgcacacacaagcatctcactcggcccacggagggggccaggcttcctttgcctgaagctgttttgggaagggtctccacacaggcactgatctcccaagcttttgtcatgatgtcttttaccatttgataattttaaacattgtttttaaacccaaaacatttagtggtccgttgcctctgaagatgtaaacaaacaaatacactatttctgggaacatttatattgagattctttgtggctattggtgtgtctcacaggcaaaatttgatttggctaaaataggctcagatgtatttgtgtgcccgtgtgtgtgtgtgtgtgtgtgtgtgtgtgtgtgtgtgtatgagagagagagagactttgacggttgtagatattttttccgctttgcctactttatgttgtataatcatgtgtttactaacaagttgatgacatggatgtattcataagaccatgtaatattgatgtgattgttgtcgcttgagaaaaaaaggcaacagctgattctttcaacaactgtcacagaatggctgggctgagaacgctgcccagggccctgcagctggcgggagaggtgtctggtgggagcggtgtctggtgcgtcagcctgctgcttcgtgtctcactcgagagttgcttctggtttcacactttttaacccctctgtgctttagcagccgtgaccttgccttcattgcttcatccagtgcaggcctgggttattgaagacaccaaagtgtttctcttccagtttgaaaaccaggcaggtttacacgtgggtttcagtgtatttgcctttgaacccttcaaactaaactttagccttttggctggtgttgaatgtctttagctggggtgacctggagtgacctgggacggtgttgtggtttaccgtctccagcttcagcctttccagaaacccttgtggagggcagtgttggctgcaggtttcatcatattgcagtttgaggtcaccactatttggggaacaagcttgcgtcctgctgaggggcaggattttcagcagagcgtcggtggggctgggccgtcgtggaggtggccccaggagtcatatggccatactcagacacaccttgtgtggcctgctcagagctggatgccacctttaggcaatgtttagagtctattttctaaagttttaagtattttaagaggtattgagactaatgaatataatagttcagtaatttaaatgcttatttattttcagtggaaggatttttattaaaaagaagctaattgacatggaaatgtcagtgaaatttcttacctgcaaggaaagtgaacattttgtatttaagtaaactataatgtgcacattttaataaagaaatctgacatttg

SEQ ID NO: 172873 - DNA, 1648 bp, Homo sapiens
  Payload ID: 13976
  Gene Symbol: QDPR
  Gene Name: quinoid dihydropteridine reductase
  Uniprot ID: P09417
  ENST ID: ENST00000281243
  CDS Start-End: 181-915
acagtccctccgggtggcggggcgccccgagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgttgatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactacatggactctgtcctggtatccttttcctgtgtggttgccccgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctgatgttctcagaagggggtggatttaaatcctgaaataaatatttcaacacaa

SEQ ID NO: 172874 - DNA, 1278 bp, Homo sapiens
  Payload ID: 13976
  Gene Symbol: QDPR
  Gene Name: quinoid dihydropteridine reductase
  Uniprot ID: P09417
  ENST ID: ENST00000428702
  CDS Start-End: 33-674
ggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactgggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgttgatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactacatggactctgtcctggtatccttttcctgtgtggttgccccgtgtcctctggcctagggttaagtgtgcaagataactactcgtgagtattcagaatgttgttcctaataaatgcacttgttgtctgtcttcttt

SEQ ID NO: 172875 - DNA, 1068 bp, Homo sapiens
  Payload ID: 13976
  Gene Symbol: QDPR
  Gene Name: quinoid dihydropteridine reductase
  ENST ID: ENST00000505710
  CDS Start-End: 1-386
gatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctgggttaccctggataccccgatgaacaggaaatcaatgcctgaggctgacttcagctcctggacacccttagaattcctagttgagtgagtattacagacatgtccatgactgagcagcttccagcccctattctctgcctgctgtggtccagaggacaagtctgtgttccctgagatcgtcaatccgggtggtcttgggaggtctctgggactctgaggatgcattgcacatcagacggaatctcagagtagctggacttggagacaggcagcacagtggcagaatgggtagtgccgacatgaatcctggctcgctccctcaccaccggccatgctgagcacattattgacctgctgaggcctcagtttccccacctgtatcatgaggtccatcatgcttgttaggattaaacgtgatagtgtgcggcaagcactcaacacagtgtctggccataacaagtgctcagtgatccccagctgcagtttgtgtccttactgctgtgatgaggagactccatgggggagggggacaccacgtagatggcctgggggcacatatctgaatctgtgtcaagccacagacccacagaaagtgccctttaatttccgaaatcctttttgcccatttgtgaatatgggtggcatttgaacgctcatgggacagagagctgaattcctcttttgtgtttgtttaggtatcagttc

SEQ ID NO: 172876 - DNA, 1188 bp, Homo sapiens
  Payload ID: 13976
  Gene Symbol: QDPR
  Gene Name: quinoid dihydropteridine reductase
  ENST ID: ENST00000513615
  CDS Start-End: 36-494
ttcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctgggttaccctggataccccgatgaacaggaaatcaatgcctgaggctgacttcagctcctggacacccttagaattcctagttgaaactttccatgactggatcacagggaaaaaccgaccgagctcaggaagcctaatccaggaactgactcagctgcaggaggacagcttcaattccctatgagttcatctcggacccaaccaatcagagctcttgactcactggcttccccctacccaccaagttgtccttaaaaactttgatccccgaatgcttggggaaaccaatctgagtaataataaaactcaagtcacctgcacagctggctctgtgtgaattactctctctattgcaattcccctgtcttgataaaatggctctatctaggcagctggcaaggtgaatccattgggtggttacaatacctcccttagtagactaaagaacaacttggataaaaccagcaagaaatggattatatcgagggaaattgtcatgcccatccaagaccatgataaggaatgaggaagtaacataatggaaggattctgtctcttctcattgggactgactctaagcacctctgattagatgtcattctatgtctgggatgatctcaggactatggtattgtcctcttgtgctatcaattttaactcacaaatggatgtcgatgtcatttattctcttattctacagaccttcattggctacat

SEQ ID NO: 172877 - DNA, 1374 bp, Homo sapiens
  Payload ID: 13976
  Gene Symbol: QDPR
  Gene Name: quinoid dihydropteridine reductase
  ENST ID: ENST00000507439
  CDS Start-End: 16-474
gctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctgggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctaggacagtgtaatacatttatgtgaagtaaagacatgcgagactggtggcctgcaaatagcatccgttgatctgtgttaactgcatagggagggctctgcatagcacctgctatagcggtgtcatgttggatcgcttttgtgactgttcatctgtccttgacagtggctgtcatcttgactactttgttgatttgttggtattggggacattttaaaggctgagttatttttgaatgtcatgtttatgtcatagacgtagttttcgcatccttgaattaaactgccttaactccttttgtggtataagcaaaactacatggactctgtcctggtatccttttcctgtgtggttgccccgtgtcctctggcctagggttaagtgtgcaagataactactcgtgagtattcagaatgttgttcctaataaatgcacttgttgtctgtcttctttaatcaaatcacatcttatatacagcagtcagagatgagtatactagaatcatggattgctggaggtcttttaatctgatgttctcagaagggggtggatttaaatcctgaaataaatatttcaacacaa

SEQ ID NO: 172878 - DNA, 781 bp, Homo sapiens
  Payload ID: 13976
  Gene Symbol: QDPR
  Gene Name: quinoid dihydropteridine reductase
  ENST ID: ENST00000514300
  CDS Start-End: 153-263
gagcgtggcagcgcgctaggcggcagcagcgggcgcggagcggggcgcggccgccgcgcgttccctcttggcggggttggccggccggggcggggcgcggcgctccggctcgaggcattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggatttgagtaacaacagataccatatggccagcaaagcctaagtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctgggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaacc

SEQ ID NO: 172879 - DNA, 601 bp, Homo sapiens
  Payload ID: 13976
  Gene Symbol: QDPR
  Gene Name: quinoid dihydropteridine reductase
  ENST ID: ENST00000508623
  CDS Start-End: 34-522
cggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctagcatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctgaactttccatgactggatcacagggaaaaaccgaccgagctcaggaagcctaatccaggtggtaaccacagaaggaaggacggaactcaccccagcatatttttaggcctcatctcagtgcctatgaggggc

SEQ ID NO: 172880 - DNA, 2343 bp, Homo sapiens
  Payload ID: 13977
  Gene Symbol: QPRT
  Gene Name: quinolinate phosphoribosyltransferase
  Uniprot ID: Q15274
  ENST ID: ENST00000395384
  CDS Start-End: 162-1055
ggcctggcagaggacaggagggaggcttggggagcctgggaagggccggctgacagcttgatgggccctccctccctccacagtcccacccccagcctggggcctctgggagccttggtcctgagcagccaacacaccagcccagacagctgcaagtcaccatggacgctgaaggcctggcgctgctgctgccgcccgtcaccctggcagccctggtggacagctggctccgagaggactgcccagggctcaactacgcagccttggtcagcggggcaggcccctcgcaggcggcgctgtgggccaaatcccctggggtactggcagggcagcctttcttcgatgccatatttacccaactcaactgccaagtctcctggttcctccccgagggatcgaagctggtgccggtggccagagtggccgaggtccggggccctgcccactgcctgctgctgggggaacgggtggccctcaacacgctggcccgctgcagtggcattgccagtgctgccgccgctgcagtggaggccgccaggggggccggctggactgggcacgtggcaggcacgaggaagaccacgccaggcttccggctggtggagaagtatgggctcctggtgggcggggccgcctcgcaccgctacgacctgggagggctggtgatggtgaaggataaccatgtggtggccgccggtggcgtggagaaggcggtgcgggcggccagacaggcggctgacttcactctgaaggtggaagtggaatgcagcagcctgcaggaggccgtgcaggcagctgaggctggtgccgaccttgtcctgctggacaacttcaagccagaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttgagcccaactctggctctgccacctgctgctcctgtgacctgtcagggctgacttcacctctgctcatctcagtttcctaatctgtaaaatgggtctaataaaggatcaaccacatggggttctgcggtgataatgagcacatagtgaggggtcagcaaatgtcagaagttacctgggacagccgggcacgatggctcacacctgtaatcccagcactttgggaggctgaggcgggaagatcacttgagttcaggagtttgagaccagcctggccaacatggtgaaaccccatctctaccaaaaatagaagaattagctgggtgtggtggcacgcgcctgtaatcccagctacttaggaggctgaggcaggagaatcgcttgaacccaggaagtggaggttgcagtgagctgatggtgccactgcactccagcctgggtgatagagcgagactctgtctccaaagaagaaacaaaggaaagaaagagagaaagagagagggagggagggagggagggaaaggaaggatggaaagaaaggaagaaaggcaggcaaaagccccagacaggccaaaaccttcatccttcatgcacccaacctgtaccaaacaccagcatggcctggctgtgagtgcacagcagatggaggtttgctgggcagagacactgggctggcctagacactgcctttggtgataccctaaaccaaaggggccagtcccacagtaagaaggagaccactactactcctgctgccctcctccccccaccttgcctagtttacaagacaggaggaaagagagaaagcaaaaagttagaaaacaaaacaaaacagaagtaagataaatagccagaagaccttggcgacaccacccggccctggtagttaaaaaaaagtaacaataataataatatcaacccctgacctaaactacttgtgttatctgtaaattccagacattgtatgaaaaagcattgcaaaactttctgctctgttagctgatgcgtgtagcccccagtcacgttccccgcttgcttgagatatcatgaccctttcacgtggaccccttagagttgtaagcctttaaaaaggccaagaatttctttttcagggatctcagctattaagatgcaagtctgccaatgctcctggccaaataaacctcttccttctttaa

SEQ ID NO: 172881 - DNA, 579 bp, Homo sapiens
  Payload ID: 13977
  Gene Symbol: QPRT
  Gene Name: quinolinate phosphoribosyltransferase
  ENST ID: ENST00000562473
  CDS Start-End: 17-466
acagctgcaagtcaccatggacgctgaaggcctggcgctgctgctgccgcccgtcaccctggcagccctggtggacagctggctccgagaggactgcccagggctcaactacgcagccttggcggtgcgggcggccagacaggcggctgacttcactctgaaggtggaagtggaatgcagcagcctgcaggaggccgtgcaggcagctgaggctggtgccgaccttgtcctgctggacaacttcaagccagaggagctgcaccccacggccaccgtgctgaaggcccagttcccgagtgtggctgtggaagccagtgggggcatcaccctggacaacctcccccagttctgcgggccgcacatagacgtcatctccatggggatgctgacccaggcggccccagcccttgatttctccctcaagctgtttgccaaagaggtggctccagtgcccaaaatccactagtcctaaaccggaagaggatgacaccggccatgggttaacgtggctcctcaggaccctctgggtcacacatctttagggtcagtggccaatggggcacatttggcactagcttg

SEQ ID NO: 172882 - DNA, 1773 bp, Homo sapiens
  Payload ID: 13978
  Gene Symbol: R3HCC1
  Gene Name: R3H domain and coiled-coil containing 1
  ENST ID: ENST00000265806
  CDS Start-End: 269-1591
tgtctgggtctcggttttgccatgaatatgaaagctagtcgtgtcactctaggagaagcggtttgtgttggtggcaggtgcgccccctcccaataggtgacaagaacacgcactctcccgttcctgcgttacctcccccaggccgcgcggtggcgctgcgtctctgcagcggcccgggtctctctagggcgctcgggcgcgctggcccctggggacgccgagggcggctgcgacgcgccgagaggccgcggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacacagggaaccaagcagtcaaagctcaaagccttgcagaggccaaaactcctgcgtctggtgaaggagaggccacagacaaatgcgactgtggcccggcggctggtggcccgggccctgggactccaacacaaaaagaaagagcggcctgctgtccggggtccgctgccgccctgaggcctggagacccaactggcctggatctgcgtcccgacgtagctggcgcccccaacaccataagccttcacagacgccagagcagccccgcaccaccctcgagcttcaccatggggtgtggtgggctttagtttagtcccagaaatggagaaaaaataaaaactcacgttgttctaatgtga

SEQ ID NO: 172883 - DNA, 1467 bp, Homo sapiens
  Payload ID: 13978
  Gene Symbol: R3HCC1
  Gene Name: R3H domain and coiled-coil containing 1
  Uniprot ID: Q9Y3T6
  ENST ID: ENST00000411463
  CDS Start-End: 1-1443
atgaatatgaaagctagtcgtgtcactctaggagaagcgggcgctcgggcgcgctggcccctggggacgccgagggcggctgcgacgcgccgagaggccgcggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacacagggaaccaagcagtcaaagctcaaagccttgcagaggccaaaactcctgcgtctggtgaaggagaggccacagacaaatgcgactgtggcccggcggctggtggcccgggccctgggactccaacacaaaaagaaagagcggcctgctgtccggggtccgctgccgccctgaggcctggagacccaactggcctgg

SEQ ID NO: 172884 - DNA, 953 bp, Homo sapiens
  Payload ID: 13978
  Gene Symbol: R3HCC1
  Gene Name: R3H domain and coiled-coil containing 1
  ENST ID: ENST00000521588
  CDS Start-End: 103-953
gccctttcggtgccggcgttgcggggtcgcgggagatccgggggtctgtgctctgattcccggccctgcccgtctctcttacaggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcagga

SEQ ID NO: 172885 - DNA, 985 bp, Homo sapiens
  Payload ID: 13978
  Gene Symbol: R3HCC1
  Gene Name: R3H domain and coiled-coil containing 1
  ENST ID: ENST00000519952
  CDS Start-End: 53-985
gccgagggcggctgcgacgcgccgagaggccgcggctctcccacctgtcaccctggcccttctctgcttggatggtgtcttcctctcctcagccgagaatgacttcgtccaccggatccaggaggaactggaccgctttctgctgcagaagcagctgtcaaatcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggta

SEQ ID NO: 172886 - DNA, 781 bp, Homo sapiens
  Payload ID: 13978
  Gene Symbol: R3HCC1
  Gene Name: R3H domain and coiled-coil containing 1
  ENST ID: ENST00000518840
  CDS Start-End: 111-781
gtcgtcccgacccccgggctcccgggtgggaaggagcagctgggctgcgcggagcaggcccccgtgagccccgggaaggagcgcagcgcagggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaa

SEQ ID NO: 172887 - DNA, 569 bp, Homo sapiens
  Payload ID: 13978
  Gene Symbol: R3HCC1
  Gene Name: R3H domain and coiled-coil containing 1
  ENST ID: ENST00000520480
  CDS Start-End: 1-447
gaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacacagggaaccaagcagtcaaagctcaaagccttgcagaggccaaaaaccatggtgagagattttagacacgagttttccatgacttcaaagtagtaactagtaaaatggacctgcaagaggcctgccgaggccagctgtgctctcgtgggtggttacgtagccaacatggtccagggtttcttggaacaataaatatcctgtccgtaggtctgtga

SEQ ID NO: 172888 - DNA, 1489 bp, Homo sapiens
  Payload ID: 13978
  Gene Symbol: R3HCC1
  Gene Name: R3H domain and coiled-coil containing 1
  ENST ID: ENST00000625275
  CDS Start-End: 269-1465
tgtctgggtctcggttttgccatgaatatgaaagctagtcgtgtcactctaggagaagcggtttgtgttggtggcaggtgcgccccctcccaataggtgacaagaacacgcactctcccgttcctgcgttacctcccccaggccgcgcggtggcgctgcgtctctgcagcggcccgggtctctctagggcgctcgggcgcgctggcccctggggacgccgagggcggctgcgacgcgccgagaggccgcggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaaggtgtgagaatgagccactgctggaccctgttggccctgagcctctggggcctgagagtcagtcagggaagggagacatggtggagatggccacacggtttgggtccaccctgcagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacacagggaaccaagcagtcaaagctcaaagccttgcagaggccaaaactcctgcgtctggtgaaggagaggccacagacaaatgcgactgtggcccggcggctggtggcccgggccctgggactccaacacaaaaagaaagagcggcctgctgtccggggtccgctgccgccctgaggcctggagacccaactggcctgg

SEQ ID NO: 172889 - DNA, 271 bp, Homo sapiens
  Payload ID: 13978
  Gene Symbol: R3HCC1
  Gene Name: R3H domain and coiled-coil containing 1
  ENST ID: ENST00000517633
  CDS Start-End: 143-271
gtggttatctgagcttcagtgggcacattcctatctcttgggctttactaacccttgtacttggaagttcatccagagaactcacaacgatactgggggctgctctcacatactcactttgcaggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttcccccca

SEQ ID NO: 172890 - DNA, 1500 bp, Homo sapiens
  Payload ID: 13978
  Gene Symbol: R3HCC1
  Gene Name: R3H domain and coiled-coil containing 1
  ENST ID: ENST00000522012
  CDS Start-End: 269-874
tgtctgggtctcggttttgccatgaatatgaaagctagtcgtgtcactctaggagaagcggtttgtgttggtggcaggtgcgccccctcccaataggtgacaagaacacgcactctcccgttcctgcgttacctcccccaggccgcgcggtggcgctgcgtctctgcagcggcccgggtctctctagggcgctcgggcgcgctggcccctggggacgccgagggcggctgcgacgcgccgagaggccgcggctctcccacctgtcaccctggcccttctctgcttggatggtgtcttcctctcctcagccgagaatgacttcgtccaccggatccaggaggaactggaccgctttctgctgcagaagcagctgtcaaaggttcttcttttccccccactctccagtcgcctccggtacctgatccatagaacagcagagaattttgatctcttgagcagcttctccgttggggagggctggaagaggaggacggtcatctgtcaccaggacatcagggtacccagttcggatggcctctctggcccctgccgcgctcctgcctcctgccccagcaggtaccacggtcctcggcccatctccaaccaaggagcagctgcggttccccgaggtgcccgggctggccggtggtatcgtggacgcaagcctgaccagcctttgtatgtgccccgggtgctgcgcaggcaggaagaatgggggctgacctctacctcggtgctcaagagagaggccccagctggcagggacccagaagagcctggagatgttggtgctggagaccccaactctgatcagggactccctgtgctgatgactcagggaacagaggacctaaagggcccaggacaaagctagacctggaaaaggggaaggagagtctgttggagaagaggctggtggcagaggaggaagaggacgaagaggaggtggaagaggatggccccagcagctgctcggaggacgattacagtgagctgctgcaggagatcacagacaacctgacgaagaaggagattcagatagagaagatccatttggacacatcctccttcgtggaggagctgcctggagagaaggaccttgcccacgtggtagagatctatgactttgaaccagcgctcaagacggaggacctgctggcaacgttttctgagttccaagagaaggggttcaggattcagtgggtggatgatactcacgcactcggcatctttccctgcctggcctcagctgcggaagccctgacccgggagttctcggtgctcaagatccggcccctcacacagggaaccaagcagtcaaagctcaaagccttgcagaggccaaaactcctgcgtctggtgaaggagaggccacagacaaatgcgactgtggcccggcggctggtggcccgggccctgggactccaacacaaaaagaaagagcggcctgctgtccggggtccgctgccgccctgaggcctggagacccaactggcctgg

SEQ ID NO: 172891 - DNA, 3379 bp, Homo sapiens
  Payload ID: 13979
  Gene Symbol: R3HCC1L
  Gene Name: R3H domain and coiled-coil containing 1-like
  Uniprot ID: Q7Z5L2
  ENST ID: ENST00000298999
  CDS Start-End: 304-2640
gcggagacggcggaagcggagagcaacagcgcgccgagacttccagtgtcctactattgaagcctgcacctgctgcattgctgttttcctgagacggagttttgccatgttgtccaggctggtgtcgaaatcctgagctcaagtggtctgcctgcctcggcttcccaaagtgctgggattacaggtgaggctgctgtcagaaaggaacttttacacagtttgccttcagagacagtctatcggcatgttgtagagttttattactaagaaaataaatgttacttacatgattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccaaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcacacagagggaattactgccattgaggagagctgggagtctatgtttaacgatgatggtgactgcctggatccacgtcttctacaagagttatcagggaataccaagagcagagagagcatccaggaacctagatctgattactacaatcatgaagttcctgatattgacctcagtgattgtgaattcccacatgtcattgaaatttatgactttccccaagaatttcatactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactgcaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaagcagtaataccatgttgtaagagggaacattaaagcccattttatgacatata

SEQ ID NO: 172892 - DNA, 3198 bp, Homo sapiens
  Payload ID: 13979
  Gene Symbol: R3HCC1L
  Gene Name: R3H domain and coiled-coil containing 1-like
  Uniprot ID: Q7Z5L2
  ENST ID: ENST00000314594
  CDS Start-End: 126-2462
tttcaggtgaggctgctgtcagaaaggaacttttacacagtttgccttcagagacagtctatcggcatgttgtagagttttattactaagaaaataaatgttacttacatgattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccaaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcacacagagggaattactgccattgaggagagctgggagtctatgtttaacgatgatggtgactgcctggatccacgtcttctacaagagttatcagggaataccaagagcagagagagcatccaggaacctagatctgattactacaatcatgaagttcctgatattgacctcagtgattgtgaattcccacatgtcattgaaatttatgactttccccaagaatttcatactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactgcaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaagcagtaataccatgttgtaagagggaacattaaagcccattttatgacat

SEQ ID NO: 172893 - DNA, 3372 bp, Homo sapiens
  Payload ID: 13979
  Gene Symbol: R3HCC1L
  Gene Name: R3H domain and coiled-coil containing 1-like
  Uniprot ID: Q7Z5L2
  ENST ID: ENST00000370584
  CDS Start-End: 300-2636
aggcctgacgcgcgccccagcggcgcgagcggaagagatagagcttcgcggagacggcggaagcggagagcaacagcgcgccggtgaggctgctgtcagaaaggaacttttacacagtttgccttcagagacagtctatcggcatgttgtagagttttattactaagaaaataaatgttacttacatgatggttttactcagcatttggtgtggtggatcttacataaacctttagaacttacattagagtgttcaagtcttctgagactccagagtcacctaagattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccaaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcacacagagggaattactgccattgaggagagctgggagtctatgtttaacgatgatggtgactgcctggatccacgtcttctacaagagttatcagggaataccaagagcagagagagcatccaggaacctagatctgattactacaatcatgaagttcctgatattgacctcagtgattgtgaattcccacatgtcattgaaatttatgactttccccaagaatttcatactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactgcaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaagcagtaataccatgttgtaagagggaacattaaagcccattttatgacat

SEQ ID NO: 172894 - DNA, 941 bp, Homo sapiens
  Payload ID: 13979
  Gene Symbol: R3HCC1L
  Gene Name: R3H domain and coiled-coil containing 1-like
  Uniprot ID: Q7Z5L2
  ENST ID: ENST00000370586
  CDS Start-End: 196-750
agacggagttttgccatgttgtccaggctggtgtcgaaatcctgagctcaagtggtctgcctgcctcggcttcccaaagtgctgggattacaggtgaggctgctgtcagaaaggaacttttacacagtttgccttcagagacagtctatcggcatgttgtagagttttattactaagaaaataaatgttacttacatgttatcagggaataccaagagcagagagagcatccaggaacctagatctgattactacaatcatgaagttcctgatattgacctcagtgattgtgaattcccacatgtcattgaaatttatgactttccccaagaatttcatactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttgg

SEQ ID NO: 172895 - DNA, 1397 bp, Homo sapiens
  Payload ID: 13979
  Gene Symbol: R3HCC1L
  Gene Name: R3H domain and coiled-coil containing 1-like
  Uniprot ID: Q7Z5L2
  ENST ID: ENST00000613938
  CDS Start-End: 109-663
tttcaggtgaggctgctgtcagaaaggaacttttacacagtttgccttcagagacagtctatcggcatgttgtagagttttattactaagaaaataaatgttacttacatgttatcagggaataccaagagcagagagagcatccaggaacctagatctgattactacaatcatgaagttcctgatattgacctcagtgattgtgaattcccacatgtcattgaaatttatgactttccccaagaatttcatactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactgcaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaagcagtaataccatgttgtaagagggaacattaaagcccattttatgac

SEQ ID NO: 172896 - DNA, 3337 bp, Homo sapiens
  Payload ID: 13979
  Gene Symbol: R3HCC1L
  Gene Name: R3H domain and coiled-coil containing 1-like
  ENST ID: ENST00000612478
  CDS Start-End: 223-2601
tttcaggtgaggctgctgtcagaaaggaacttttacacagtttgccttcagagacagtctatcggcatgttgtagagttttattactaagaaaataaatgttacttacatgatggttttactcagcatttggtgtggtggatcttacataaacctttagaacttacattagagtgttcaagtcttctgagactccagagtcacctaagattgtggtggtgccatgcagcaagaatcagagagatgcagagttagagccagaaggcctgacatggcactttatgtacctaaagctcgtaggggtgcagtactccttaagacaggtgatgaagaagaaagctgtggttcacctaactctgtggtgaaagaaaagcaaaaagaaagttctctctcccaaaaagaagtctttaaagacaaaccggaggctcgaagactaaatatcaatcctgatagaaaggagcataattgtagagaagaaaagaaatcttcaacaaaattaagaatggacacatgccttcaaaaaacaaatagagtttgttctaagagaggaaccactgaatccaaagaagtattatcccaaggacaacagcagggagccccaaatgctggggttataactaatgcacctttgcagagacattttaaaccaaagaaggtggagtgtttggaagttgaaactacggatgtgacaggacatgagaggatacttctttcacaggcctgtttagaaatcagcgaggctcaagttccaagcaaaccattccaaaatgtggaattctgtgacttcagtaggcatgaacctgatggggaagcatttgaagacaaagatttggaaggcagaattgaaactgataccaaggttttggagatactatatgagtttcctagagtttttagttctgtcatgaaacctgagaatatgattgtaccaataaaactaagctctgattctgaaattgtacaacaaagcatgcaaacatcagatggaatattgaatcccagcagcggaggcatcaccactacttctgttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcacacagagggaattactgccattgaggagagctgggagtctatgtttaacgatgatggtgactgcctggatccacgtcttctacaagaggggattctgatgcacataaagcccgagaaccactgctcaaagttatcagggaataccaagagcagagagagcatccaggaacctagatctgattactacaatcatgaagttcctgatattgacctcagtgattgtgaattcccacatgtcattgaaatttatgactttccccaagaatttcatactgaagaccttctacgggttttctgcagttatcaaaagaaaggatttgatattaaatgggtggatgatacacatgccctaggagtattctccagtccaattacagctcgtgatgcgttgggtattaaacacaccatggtgaagattcgtcccttgtcacaggccacaagagcagccaaggccaaagctagagcttatgctgagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagagagagaaagcggttggaagccaagcaacgggaagacatctgggaaggcagagaccagtctacagtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactgcaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaagcagtaataccatgttgtaagagggaacattaaagcccattttatgacat

SEQ ID NO: 172897 - DNA, 4648 bp, Homo sapiens
  Payload ID: 13980
  Gene Symbol: R3HDM1
  Gene Name: R3H domain containing 1
  Uniprot ID: Q15032
  ENST ID: ENST00000264160
  CDS Start-End: 371-3670
cggtgtccgggctggtgatggggttaattccctttcgtaagactcttacttgcacccacccagccccgccgtcgccccgccgcgccgcgctccaaccgcctcctcctcctcagtaacgcgggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcagcggccattgcagtcatttggacagacaggaaaaaggtctaagtcaagctcaaagttaaagctagttcggagccttgcagtgtgtgaagaatctccaccaccccctgcaccagagatatcacaggagaaccaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggttctgagtcttctggtagtgtagggtcatctacaggctctctttctcacatccagcagcctcttccaggtacagctctcagccagtcttctcatggcgcacctgtcgtctatccaactgtcagcactcatagttctctttcctttgatggtggcctaaatgggcaagtcgcatctcctagcactagcttctttttgcttcccttggaagcggcaggcataccacctggcagtattctgatcaacccacaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatatag

SEQ ID NO: 172898 - DNA, 4272 bp, Homo sapiens
  Payload ID: 13980
  Gene Symbol: R3HDM1
  Gene Name: R3H domain containing 1
  Uniprot ID: Q15032
  ENST ID: ENST00000409478
  CDS Start-End: 383-3298
tgccgctggagccggtgtccgggctggtgatggggttaattccctttcgtaagactcttacttgcacccacccagccccgccgtcgccccgccgcgccgcgctccaaccgcctcctcctcctcagtaacgcgggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacagcaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaat

SEQ ID NO: 172899 - DNA, 4442 bp, Homo sapiens
  Payload ID: 13980
  Gene Symbol: R3HDM1
  Gene Name: R3H domain containing 1
  Uniprot ID: Q15032
  ENST ID: ENST00000410054
  CDS Start-End: 332-3466
gcatttcagatattctgggtggtgactggctagagtgttactgacatcacaacatacagctgttgactttctattgtctgagtcctcctcggcaagtgctttagactgctctagcaggcactcccaatgccagactaatcagctggatgtgtgcagtgagctctatagaggagcaatgcagagcatcagtttacaggtactatggaaagaacatctccttaactctgtatgatgaagcaaataccaatacaatgaaggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggttctgagtcttctggtagtgtagggtcatctacaggctctctttctcacatccagcagcctcttccaggtacagctctcagccagtcttctcatggcgcacctgtcgtctatccaactgtcagcactcatagttctctttcctttgatggtggcctaaatgggcaagtcgcatctcctagcactagcttctttttgcttcccttggaagcggcaggcataccacctggcagtattctgatcaacccacaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacagcaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatat

SEQ ID NO: 172900 - DNA, 3673 bp, Homo sapiens
  Payload ID: 13980
  Gene Symbol: R3HDM1
  Gene Name: R3H domain containing 1
  Uniprot ID: Q15032
  ENST ID: ENST00000409606
  CDS Start-End: 320-3622
agtttacaggtactatggaaagaacatctccttaactctgtatgatgaagcaaataccaatacaatgaaggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcagcggccattgcagtcatttggacagacaggaaaaaggtctaagtcaagctcaaagttaaagctagttcggagccttgcagtgtgtgaagaatctccaccaccccctgcaccagagatatcacaggagaaccaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggttctgagtcttctggtagtgtagggtcatctacaggctctctttctcacatccagcagcctcttccaggtacagctctcagccagtcttctcatggcgcacctgtcgtctatccaactgtcagcactcatagttctctttcctttgatggtggcctaaatgggcaagtcgcatctcctagcactagcttctttttgcttcccttggaagcggcaggcataccacctggcagtattctgatcaacccacaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacagcaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatct

SEQ ID NO: 172901 - DNA, 581 bp, Homo sapiens
  Payload ID: 13980
  Gene Symbol: R3HDM1
  Gene Name: R3H domain containing 1
  ENST ID: ENST00000425804
  CDS Start-End: 1-581
taataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagc

SEQ ID NO: 172902 - DNA, 556 bp, Homo sapiens
  Payload ID: 13980
  Gene Symbol: R3HDM1
  Gene Name: R3H domain containing 1
  ENST ID: ENST00000441871
  CDS Start-End: 1-556
cattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggttctgagtcttctggtagtgtagggtcatctacaggctctctttctcacatccagcagcctcttccaggtcagcccttcataaacccagatgggagtccagttgtgtataatcctcctatgactcaacaaccagttagatcccaagtgcctggacctccacagccacctctgccagccccacctcaacaaccagcagctaatcacattttctcacagcaggataacctagggtctcagtttagccacatgagtcttgctcgc

SEQ ID NO: 172903 - DNA, 3443 bp, Homo sapiens
  Payload ID: 13980
  Gene Symbol: R3HDM1
  Gene Name: R3H domain containing 1
  ENST ID: ENST00000429703
  CDS Start-End: 1-2470
caacagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggttctgagtcttctggtagtgtagggtcatctacaggctctctttctcacatccagcagcctcttccaggtacagctctcagccagtcttctcatggcgcacctgtcgtctatccaactgtcagcactcatagttctctttcctttgatggtggcctaaatgggcaagtcgcatctcctagcactagcttctttttgcttcccttggaagcggcaggcataccacctggcagtattctgatcaacccacaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacagcctgttcatcctctgcagtcctcttcacagcctgttcagtactctacagccccttacccatccccgttcctgccagtctcacccacccagcaatactctgtgcaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaa

SEQ ID NO: 172904 - DNA, 582 bp, Homo sapiens
  Payload ID: 13980
  Gene Symbol: R3HDM1
  Gene Name: R3H domain containing 1
  ENST ID: ENST00000438014
  CDS Start-End: 433-582
gtccgggctggtgatggggttaattccctttcgtaagactcttacttgcacccacccagccccgccgtcgccccgccgcgccgcgctccaaccgcctcctcctcctcagtaacgcggtttcaacagtaagaaactaaatcactgccttgtacaataaaaagctctatgttggggtgatcagacccaacaccaggtcatgggggcgatgagtccggtggagtcaaaggaatgagaaaaagacagtttgagagagaaagtgggaccggggagcctacgctatttattggtgatcaaacaaagaaacagggcgtattggtgacctctcggaagaaagggataaggagtcgtcacttggccggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctg

SEQ ID NO: 172905 - DNA, 851 bp, Homo sapiens
  Payload ID: 13980
  Gene Symbol: R3HDM1
  Gene Name: R3H domain containing 1
  ENST ID: ENST00000456040
  CDS Start-End: 1-851
ctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcagtcaagctcaaagttaaagctagttcggagccttgcagtgtgtgaagaatctccaccaccccctgcaccagagatatcacaggagaaccaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagat

SEQ ID NO: 172906 - DNA, 670 bp, Homo sapiens
  Payload ID: 13980
  Gene Symbol: R3HDM1
  Gene Name: R3H domain containing 1
  ENST ID: ENST00000445855
  CDS Start-End: 1-670
gtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagacctt

SEQ ID NO: 172907 - DNA, 601 bp, Homo sapiens
  Payload ID: 13980
  Gene Symbol: R3HDM1
  Gene Name: R3H domain containing 1
  ENST ID: ENST00000436436
  CDS Start-End: 405-601
agactgctctagcaggcactcccaatgccagactaatcagctggatgtgtgcagtgagctctatagaggagcaatgcagagcatcagtttacaggtactatggaaagaacatctccttaactctgtatgatgaagcaaataccaatacaatgaaggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcagggacagaatgatgctgctgaaattgg

SEQ ID NO: 172908 - DNA, 4325 bp, Homo sapiens
  Payload ID: 13980
  Gene Symbol: R3HDM1
  Gene Name: R3H domain containing 1
  Uniprot ID: Q15032
  ENST ID: ENST00000628915
  CDS Start-End: 434-3349
ttgtctgagtcctcctcggcaagtgctttagactgctctagcaggcactcccaatgccagactaatcagctggatgtgtgcagtgagctctatagaggagcaatgcagagcatcagtttacaggtactatggaaagaacatctccttaactctgtatgatgaagcaaataccaatacaatgaaggccacggaaaggtatgatatatttgatccaagacagtccattccagtccgggaatctacagtggtgacaaggacatgggactcctcctgccagattacagatggttcactacagttgacatcctggctgacaactgtgaaaaagaaccttggattattttattttatttttgtgggacaccacaatcccaaatccaaaggacgcatcaggcttcaagctccctgtagaattcgaaaataaccttttctaatgaggatgtctgatactgttactgtaaaagatgaaactgcaacaatgaaggatttggaggcagaagtgaaagatacaaccagagttgaaaatcttatcaaatcagaaaactatgggaagattttggtagagaagaatgaacattgtattgagaacaatatagatttgcaggagaaaattcagatccagttaacacaatcatttgagaaagaagagaagccctcaaaagatgaagcagaaaaagaaaaggccagtgataagttgcccagaaaaatgttatcaagagattccagtcaagaatacactgattcaactggcatagatctacatgaatttttagtaaatacattaaaaaacaatcccagggacagaatgatgctgctgaaattggaacaagaaattttagatttcattggtaataatgagtctccacgtaaaaaattccccccaatgacatcttaccataggatgctattacacagagtagccgcttactttggattagaccacaatgttgatcagagtgggaagtctgtcatagtaaacaaaactagcaatacaagaatacctgatcagaaatttaatgaacatattaaggatgataaaggtgaagactttcagaaacgttatatcctcaagagagataactctagctttgacaaagatgataaccagatgagaatacgtttgaaagatgacagaagaagcaaatctatagaagaaagagaagaagagtaccagagagccagagaccgaatattttcccaagattccctgtgttcccaagagaattacattattgacaaaagactccaagacgaggatgccagtagtacccagcagaggcgccagatatttagagttaataaagatgcttcagggagatctacaaatagccatcaaagcagcactgagaatgagttgaagtactcggaaccacgaccctggagcagcacagattcagacagctctcttcgaaacctgaaacctgctgtaaccaaagccagcagcttcagtggaatctcagtcctgacaagaggtgatagttctggaagcagcaaaagcataggcaggctttcaaaaacaggtcagcccttcataaacccagatgggagtccagttgtgtataatcctcctatgactcaacaaccagttagatcccaagtgcctggacctccacagccacctctgccagccccacctcaacaaccagcagctaatcacattttctcacagcaggataacctagggtctcagtttagccacatgagtcttgctcgccagccatctgctgatggttctgaccctcatgccgccatgttccagtccactgtggttcttcagtctccacagcagtctggttatatcatgacagcagcccctccaccacatcctcctccaccgccaccaccaccacctcctcctcctcccctaccacctgggcagccagtccctactgctggatatcctgcctctggtcatcctgtcagccagcctgtgctccagcagcagggatatattcagcagccatcaccacagatgccagcctgttattgcgctccaggccactatcactccagccaacctcagtatcgcccagtcccttctgttcattacaattcacatctaaaccaaccactgccacaacctgcgcagcagacaggttatcaagttatacccaaccagcagcaaaactaccaaggaatagttggagttcagcaaccccagagtcagagcctagtcagtggccaacccaacagcattggaaatcagattcaaggagtggtcatcccctatacttcagtgccaacatatcaggtttcactgcctcaaggttctcaaggaattccccatcagacttatcaacagcctgttatgttccctaatcagtctaatcaaggatctatgcccacaacaggaatgcctgtttactatagtgtcattccacctggtcaacaaaacaatttaagctcttcagtaggttacctgcaacatccaggatcagaacaagtacaatttcctcgaaccacttcaccatgcagttcccagcagcttcaaggccaccaatgtacagctggaccaccaccgccacctggtggggggatggtgatgatgcagctcagtgtaccaaacaatccacaatcttgtgcccactcacccccgcagtggaaacaaaacaaatattactgtgatcaccagagaggacagaagtgtgtagaatttagcagtgtagacaatattgtccagcacagccctcaactcagtagccccattatttcaccagctcagtcgccagcaccagctcagctgtccaccctgaaaactgtacgtccctctggaccaccactttccatcatgccccaattttctagaccttttgtccccgggcaaggagattccaggtatccattacttggccagccactgcagtacaatcctcctgctgttctgcacggacacattccaaaccaacagggtcagcctggcagcaggcatggaaaccgaggaaggagacaagctaaaaaagctgcatccacagaccttggagcaggagaaacagttgttgggaaggtcttggaaattactgaactaccagatggaataactcgcatggaagctgaaaagctttttggggaactctttaaaattggcgccaagatccggtggctccgggacccccagtcccaaccacgtcgtcaccccctctgctgtggcagtggggacaacactgccaaccctgaacgctctaaacccagtgacttggcctccacctacaccgtcttagccacattcccctccatttcagctgcacagaatgcactgaagaaacaaattaactcagttaacaagtttaagctgagaacaagcaagaagcactatgactttcacattttggaaagggcaagttctcagtaacagccacctttggacccttcgcctttatggttcccctgccctctcccatctttgattggcttggtatttggagcttctgttaacattatagagactcctaggatgtgtgttcatggcattatagcttttgaagaaaggccagtgatccagcaaagggggaaaaatatgcatttcaccccacatgactaggaatccacatcagaatgatacagagttagcaggtttttctaaggaaatgccattcaaatgcctcctaacttttatagttattttgttttatatttctaaattcttgtatcagatccaaagctctattgtacagcaaattattcttcaaaatgattataaccagttgcaccctgtatttctttttgcagccagcacaatgtgacccaacttaaaatttgggggaaaaagaatgcaggagtgaaataaccaagtcaaaaccatgtactatctccttgggggttagggatgctaagaagagcccacaaatagaggattactcttcccctgaatctctaaactcagaaacaattaccaaaaaatacataactcttccttgtagggccctttccttattcatttaggtagtgtgaacattaagtataaaataaattatgttcttaatgcctcttaaaccacttacattcaaaggggaacagaaatcattctaagcaggaaaatacttccactttttttttttcaagtatctctctaataactaaatgccacttatttgcattctccttgtggattttttgtcacctaaggaaatgcatttgatgagtgctggaaacttcttaagtgctttacagtttgttttcattgtttgcagcggatcactggacatcaaagattcattgcacttatgaacaaggaaccttcttttcaatttctgtgtaatttgcaaggctgtacaatgtgtgctgatgcaagcctttttcagttcaagagaataaatgtttacaaatat

SEQ ID NO: 172909 - DNA, 4331 bp, Homo sapiens
  Payload ID: 13981
  Gene Symbol: R3HDM2
  Gene Name: R3H domain containing 2
  Uniprot ID: Q9Y2K5
  ENST ID: ENST00000347140
  CDS Start-End: 392-3322
ggcttttcttccccttctgattttcccctccccccttttctccctttccgggtttggttccccccttttcttcccctctcccccctccttcccaagcccctttcccctcccccgtcccagtcccccctgcttcccagccctcggccccggggaagccccggccgagaaaagcccgcccccagaagcgcgccgccgccggccgtcggggccgagccgcagccgagcggccgtgggcccgggcggcgggcggagacgtgggcgccctccccgccaaggcccgtgcgagaggttagacttgtttcttatatgtgatgccattccagcactggactcatggaggctgagcatttattcaggagtccatagaggccactgtattctattgaagaacatgtctaacagtaacactactcaagagaccctggaaataatgaaagaatcagaaaaaaaactggtggaagaatctgtaaacaaaaacaagtttatatctaagactccaagtaaggaagaaattgagaaagaatgtgaagataccagtttgcgtcaggagacacagaggcggacatctaaccatggtcatgccaggaaaagagccaagtctaattccaagctaaagttggtgcgtagcctggcagtgtgtgaggagtcctccaccccatttgctgatgggccattagaaacccaggatataattcaattgcacatcagttgcccttctgacaaggaggaagaaaagtccacaaaagatgtctctgaaaaggaagacaaggacaaaaacaaagaaaagatcccaaggaagatgctgtccagagactccagccaggaatatacggactccactggaatagacctacatgaatttcttgtaaatacactgaaaaagaacccaagggacagaatgatgctgctaaaattagaacaggagattctggaatttattaatgacaacaataatcagttcaagaagttccctcagatgacctcatatcaccggatgctattacaccgggtagctgcctattttgggatggaccacaatgttgatcaaactgggaaagctgtcatcatcaacaaaactagtaacacaagaatccctgaacagaggttctcagaacatataaaggatgagaagaatacagaatttcaacagaggttcattctcaagagagatgatgccagtatggaccgagatgataaccagactggccagaacggatatctaaatgacatcagactctccaaagaagccttttcttctagctctcacaagagaaggcagatttttagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggtttctgcaaccccctggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaagcactcaaatctgcctccactgacctggggacagcagatgttgtcctggggcgggtgctggaggtgacagatctccctgagggcatcacccgtactgaggcggacaaactcttcacgcagctcgccatgtctggcgccaagatccagtggctcaaggatgctcaggggctgcctggagggggtgggggggacaacagtgggactgctgagaatggccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacagaaggagcaagggcagggtggagggggttgaaggatcctgacagaccatggacagaggcaggaagtaaggaaactgatgttaaactggaacctaagacagtgatgaagatggaaacacagatacctacactggcattggactccttcttgctcccctgccatgggtcctctctttttccctggttgaccccccttgcatcactcttcttcccatcctcttctttttttttttttttttttttttgagacggagtttcgctcttgtcaccccagctggagtgcagtagcacgatcttggctaactgcaacctccagctcctgggttcaggtgattctcctgcctcagcctcccaagtagctggcactacagacacgcgccaccatgcccggctaatttttgtatttttagtagagacggagtttcaccatgttggccaggctggcctcaaactcctgacctcaggtgatccacctgccttggccttccagagtgctgggattacaggcgtgagccactgtgcctggcttccatcctcttctatcatttttttaaatctcttctcctatcataaaattaatttctcattttttggtcaggtagaattgggaaagtcccacactgtcctcctattaccttaacatcccaagcttcctttccttttttggtctttatgaatatatttatatggacagaattaagataaacaaaattgattgccccattctctcacttccccatcttgtcttcctagaccccacagagttaaaacttgggattcccctggcccccccagaacacttgtatattgtttgtttgaggttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaatctgtcactgga

SEQ ID NO: 172910 - DNA, 3974 bp, Homo sapiens
  Payload ID: 13981
  Gene Symbol: R3HDM2
  Gene Name: R3H domain containing 2
  Uniprot ID: Q9Y2K5
  ENST ID: ENST00000358907
  CDS Start-End: 36-2966
gagtccatagaggccactgtattctattgaagaacatgtctaacagtaacactactcaagagaccctggaaataatgaaagaatcagaaaaaaaactggtggaagaatctgtaaacaaaaacaagtttatatctaagactccaagtaaggaagaaattgagaaagaatgtgaagataccagtttgcgtcaggagacacagaggcggacatctaaccatggtcatgccaggaaaagagccaagtctaattccaagctaaagttggtgcgtagcctggcagtgtgtgaggagtcctccaccccatttgctgatgggccattagaaacccaggatataattcaattgcacatcagttgcccttctgacaaggaggaagaaaagtccacaaaagatgtctctgaaaaggaagacaaggacaaaaacaaagaaaagatcccaaggaagatgctgtccagagactccagccaggaatatacggactccactggaatagacctacatgaatttcttgtaaatacactgaaaaagaacccaagggacagaatgatgctgctaaaattagaacaggagattctggaatttattaatgacaacaataatcagttcaagaagttccctcagatgacctcatatcaccggatgctattacaccgggtagctgcctattttgggatggaccacaatgttgatcaaactgggaaagctgtcatcatcaacaaaactagtaacacaagaatccctgaacagaggttctcagaacatataaaggatgagaagaatacagaatttcaacagaggttcattctcaagagagatgatgccagtatggaccgagatgataaccagactggccagaacggatatctaaatgacatcagactctccaaagaagccttttcttctagctctcacaagagaaggcagatttttagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggtttctgcaaccccctggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaagcactcaaatctgcctccactgacctggggacagcagatgttgtcctggggcgggtgctggaggtgacagatctccctgagggcatcacccgtactgaggcggacaaactcttcacgcagctcgccatgtctggcgccaagatccagtggctcaaggatgctcaggggctgcctggagggggtgggggggacaacagtgggactgctgagaatggccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacagaaggagcaagggcagggtggagggggttgaaggatcctgacagaccatggacagaggcaggaagtaaggaaactgatgttaaactggaacctaagacagtgatgaagatggaaacacagatacctacactggcattggactccttcttgctcccctgccatgggtcctctctttttccctggttgaccccccttgcatcactcttcttcccatcctcttctttttttttttttttttttttttgagacggagtttcgctcttgtcaccccagctggagtgcagtagcacgatcttggctaactgcaacctccagctcctgggttcaggtgattctcctgcctcagcctcccaagtagctggcactacagacacgcgccaccatgcccggctaatttttgtatttttagtagagacggagtttcaccatgttggccaggctggcctcaaactcctgacctcaggtgatccacctgccttggccttccagagtgctgggattacaggcgtgagccactgtgcctggcttccatcctcttctatcatttttttaaatctcttctcctatcataaaattaatttctcattttttggtcaggtagaattgggaaagtcccacactgtcctcctattaccttaacatcccaagcttcctttccttttttggtctttatgaatatatttatatggacagaattaagataaacaaaattgattgccccattctctcacttccccatcttgtcttcctagaccccacagagttaaaacttgggattcccctggcccccccagaacacttgtatattgtttgtttgaggttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaatctgtcactgg

SEQ ID NO: 172911 - DNA, 3347 bp, Homo sapiens
  Payload ID: 13981
  Gene Symbol: R3HDM2
  Gene Name: R3H domain containing 2
  ENST ID: ENST00000403821
  CDS Start-End: 298-3330
ccctctacctccagtgacgtagtgattttgtttgcagtctttttcttctgagagggaggggacggagagaaggaagaagaaaaatccatctgaagcggtgcgttcttccttctgtgacttgatgttggtaactgggtgccattgaatagagctgaagccaaagtgggatgttttaaaggtgctataattttgtttgtttccttttaaaatagggtcagaccgaagtcagaattgctgaagcagggtgcctgaattaaccctatattccatagaggccactgtattctattgaagaacatgtctaacagtaacactactcaagagaccctggaaataatgaaagaatcagaaaaaaaactggtggaagaatctgtaaacaaaaacaagtttatatctaagactccaagtaaggaagaaattgagaaagaatgtgaagataccagtttgcgtcaggagacacagaggcggacatctaaccatggtcatgccaggaaaagagccaagtctaattccaagctaaagttggtgcgtagcctggcagtgtgtgaggagtcctccaccccatttgctgatgggccattagaaacccaggatataattcaattgcacatcagttgcccttctgacaaggaggaagaaaagtccacaaaagatgtctctgaaaaggaagacaaggacaaaaacaaagaaaagatcccaaggaagatgctgtccagagactccagccaggaatatacggactccactggaatagacctacatgaatttcttgtaaatacactgaaaaagaacccaagggacagaatgatgctgctaaaattagaacaggagattctggaatttattaatgacaacaataatcagttcaagaagttccctcagatgacctcatatcaccggatgctattacaccgggtagctgcctattttgggatggaccacaatgttgatcaaactgggaaagctgtcatcatcaacaaaactagtaacacaagaatccctgaacagaggttctcagaacatataaaggatgagaagaatacagaatttcaacagaggttcattctcaagagagatgatgccagtatggaccgagatgataaccagactggccagaacggatatctaaatgacatcagactctccaaagaagccttttcttctagctctcacaagagaaggcagatttttagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacagccagtcccggctctgcagccctctccgcagcctgttcagttctctccaagctcctgtccccaagtccttctgccagtctctccgccccagcagtacaacatggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggtttctgcaaccccctggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaagcactcaaatctgcctccactgacctggggacagcagatgttgtcctggggcgggtgctggaggtgacagatctccctgagggcatcacccgtactgaggcggacaaactcttcacgcagctcgccatgtctggcgccaagatccagtggctcaaggatgctcaggggctgcctggagggggtgggggggacaacagtgggactgctgagaatggccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagg

SEQ ID NO: 172912 - DNA, 4372 bp, Homo sapiens
  Payload ID: 13981
  Gene Symbol: R3HDM2
  Gene Name: R3H domain containing 2
  ENST ID: ENST00000402412
  CDS Start-End: 392-3364
ggcttttcttccccttctgattttcccctccccccttttctccctttccgggtttggttccccccttttcttcccctctcccccctccttcccaagcccctttcccctcccccgtcccagtcccccctgcttcccagccctcggccccggggaagccccggccgagaaaagcccgcccccagaagcgcgccgccgccggccgtcggggccgagccgcagccgagcggccgtgggcccgggcggcgggcggagacgtgggcgccctccccgccaaggcccgtgcgagaggttagacttgtttcttatatgtgatgccattccagcactggactcatggaggctgagcatttattcaggagtccatagaggccactgtattctattgaagaacatgtctaacagtaacactactcaagagaccctggaaataatgaaagaatcagaaaaaaaactggtggaagaatctgtaaacaaaaacaagtttatatctaagactccaagtaaggaagaaattgagaaagaatgtgaagataccagtttgcgtcaggagacacagaggcggacatctaaccatggtcatgccaggaaaagagccaagtctaattccaagctaaagttggtgcgtagcctggcagtgtgtgaggagtcctccaccccatttgctgatgggccattagaaacccaggatataattcaattgcacatcagttgcccttctgacaaggaggaagaaaagtccacaaaagatgtctctgaaaaggaagacaaggacaaaaacaaagaaaagatcccaaggaagatgctgtccagagactccagccaggaatatacggactccactggaatagacctacatgaatttcttgtaaatacactgaaaaagaacccaagggacagaatgatgctgctaaaattagaacaggagattctggaatttattaatgacaacaataatcagttcaagaagttccctcagatgacctcatatcaccggatgctattacaccgggtagctgcctattttgggatggaccacaatgttgatcaaactgggaaagctgtcatcatcaacaaaactagtaacacaagaatccctgaacagaggttctcagaacatataaaggatgagaagaatacagaatttcaacagaggttcattctcaagagagatgatgccagtatggaccgagatgataaccagatcagagttccattgcaggatggaaggaggagcaagtcaatagaagagagagaggaggaatatcaaagggtccgagagagaatatttgcccgagagactggccagaacggatatctaaatgacatcagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggtttctgcaaccccctggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaagcactcaaatctgcctccactgacctggggacagcagatgttgtcctggggcgggtgctggaggtgacagatctccctgagggcatcacccgtactgaggcggacaaactcttcacgcagctcgccatgtctggcgccaagatccagtggctcaaggatgctcaggggctgcctggagggggtgggggggacaacagtgggactgctgagaatggccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacagaaggagcaagggcagggtggagggggttgaaggatcctgacagaccatggacagaggcaggaagtaaggaaactgatgttaaactggaacctaagacagtgatgaagatggaaacacagatacctacactggcattggactccttcttgctcccctgccatgggtcctctctttttccctggttgaccccccttgcatcactcttcttcccatcctcttctttttttttttttttttttttttgagacggagtttcgctcttgtcaccccagctggagtgcagtagcacgatcttggctaactgcaacctccagctcctgggttcaggtgattctcctgcctcagcctcccaagtagctggcactacagacacgcgccaccatgcccggctaatttttgtatttttagtagagacggagtttcaccatgttggccaggctggcctcaaactcctgacctcaggtgatccacctgccttggccttccagagtgctgggattacaggcgtgagccactgtgcctggcttccatcctcttctatcatttttttaaatctcttctcctatcataaaattaatttctcattttttggtcaggtagaattgggaaagtcccacactgtcctcctattaccttaacatcccaagcttcctttccttttttggtctttatgaatatatttatatggacagaattaagataaacaaaattgattgccccattctctcacttccccatcttgtcttcctagaccccacagagttaaaacttgggattcccctggcccccccagaacacttgtatattgtttgtttgaggttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaatctgtcactgg

SEQ ID NO: 172913 - DNA, 2266 bp, Homo sapiens
  Payload ID: 13981
  Gene Symbol: R3HDM2
  Gene Name: R3H domain containing 2
  ENST ID: ENST00000429355
  CDS Start-End: 1-2226
aaggatgagaagaatacagaatttcaacagaggttcattctcaagagagatgatgccagtatggaccgagatgataaccaggatggaaggaggagcaagtcaatagaagagagagaggaggaatatcaaagggtccgagagagaatatttgcccgagagactggccagaacggatatctaaatgacatcagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggtttctgcaaccccctggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaagcactcaaatctgcctccactgacctggggacagcagatgttgtcctggggcgggtgctggaggtgacagatctccctgagggcatcacccgtactgaggcggacaaactcttcacgcagctcgccatgtctggcgccaagatccagtggctcaaggatgctcaggggctgcctggagggggtgggggggacaacagtgggactgctgagaatggccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacagaaggagcaaggg

SEQ ID NO: 172914 - DNA, 195 bp, Homo sapiens
  Payload ID: 13981
  Gene Symbol: R3HDM2
  Gene Name: R3H domain containing 2
  ENST ID: ENST00000448732
  CDS Start-End: 107-195
gcagccgagcggccgtgggcccgggcggcgggcggagacgtgggcgccctccccgccaaggcccgtgcgaggagtccatagaggccactgtattctattgaagaacatgtctaacagtaacactactcaagagaccctggaaataatgaaagaatcagaaaaaaaactggtggaagaatctgtaaacaaaaacaa

SEQ ID NO: 172915 - DNA, 4076 bp, Homo sapiens
  Payload ID: 13981
  Gene Symbol: R3HDM2
  Gene Name: R3H domain containing 2
  Uniprot ID: Q9Y2K5
  ENST ID: ENST00000441731
  CDS Start-End: 1053-3068
gagtccatagaggccactgtattctattgaagaacatgtctaacagtaacactactcaagagaccctggaaataatgaaagaatcagaaaaaaaactggtggaagaatctgtaaacaaaaacaagtttatatctaagactccaagtaaggaagaaattgagaaagaatgtgaagataccagtttgcgtcaggagacacagaggcggacatctaaccatggtcatgccaggaaaagagccaagtctaattccaagctaaagttggtgcgtagcctggcagtgtgtgaggagtcctccaccccatttgctgatgggccattagaaacccaggatataattcaattgcacatcagttgcccttctgacaaggaggaagaaaagtccacaaaagatgtctctgaaaaggaagacaaggacaaaaacaaagaaaagatcccaaggaagatgctgtccagagactccagccaggaatatacggactccactggaatagacctacatgaatttcttgtaaatacactgaaaaagaacccaagggacagaatgatgctgctaaaattagaacaggagattctggaatttattaatgacaacaataatcagttcaagaagttccctcagatgacctcatatcaccggatgctattacaccgggtagctgcctattttgggatggaccacaatgttgatcaaactgggaaagctgtcatcatcaacaaaactagtaacacaagaatccctgaacagaggttctcagaacatataaaggatgagaagaatacagaatttcaacagaggttcattctcaagagagatgatgccagtatggaccgagatgataaccagactggccagaacggatatctaaatgacatcagactctccaaagaagccttttcttctagctctcacaagagaaggcagatttttagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacagccagtcccggctctgcagccctctccgcagcctgttcagttctctccaagctcctgtccccaagtccttctgccagtctctccgccccagcagtacaacatggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggtttctgcaaccccctggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaagcactcaaatctgcctccactgacctggggacagcagatgttgtcctggggcgggtgctggaggtgacagatctccctgagggcatcacccgtactgaggcggacaaactcttcacgcagctcgccatgtctggcgccaagatccagtggctcaaggatgctcaggggctgcctggagggggtgggggggacaacagtgggactgctgagaatggccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacagaaggagcaagggcagggtggagggggttgaaggatcctgacagaccatggacagaggcaggaagtaaggaaactgatgttaaactggaacctaagacagtgatgaagatggaaacacagatacctacactggcattggactccttcttgctcccctgccatgggtcctctctttttccctggttgaccccccttgcatcactcttcttcccatcctcttctttttttttttttttttttttttgagacggagtttcgctcttgtcaccccagctggagtgcagtagcacgatcttggctaactgcaacctccagctcctgggttcaggtgattctcctgcctcagcctcccaagtagctggcactacagacacgcgccaccatgcccggctaatttttgtatttttagtagagacggagtttcaccatgttggccaggctggcctcaaactcctgacctcaggtgatccacctgccttggccttccagagtgctgggattacaggcgtgagccactgtgcctggcttccatcctcttctatcatttttttaaatctcttctcctatcataaaattaatttctcattttttggtcaggtagaattgggaaagtcccacactgtcctcctattaccttaacatcccaagcttcctttccttttttggtctttatgaatatatttatatggacagaattaagataaacaaaattgattgccccattctctcacttccccatcttgtcttcctagaccccacagagttaaaacttgggattcccctggcccccccagaacacttgtatattgtttgtttgaggttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaatctgtcactgg

SEQ ID NO: 172916 - DNA, 840 bp, Homo sapiens
  Payload ID: 13981
  Gene Symbol: R3HDM2
  Gene Name: R3H domain containing 2
  ENST ID: ENST00000547262
  CDS Start-End: 1-840
gaagaaaagtccacaaaagatgtctctgaaaaggaagacaaggacaaaaacaaagaaaagatcccaaggaagatgctgtccagagactccagccaggaatatacggactccactggaatagacctacatgaatttcttgtaaatacactgaaaaagaacccaagggacagaatgatgctgctaaaattagaacaggagattctggaatttattaatgacaacaataatcagttcaagaagttccctcagatgacctcatatcaccggatgctattacaccgggtagctgcctattttgggatggaccacaatgttgatcaaactgggaaagctgtcatcatcaacaaaactagtaacacaagaatccctgaacagaggttctcagaacatataaaggatgagaagaatacagaatttcaacagaggttcattctcaagagagatgatgccagtatggaccgagatgataaccagactggccagaacggatatctaaatgacatcagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcag

SEQ ID NO: 172917 - DNA, 4092 bp, Homo sapiens
  Payload ID: 13981
  Gene Symbol: R3HDM2
  Gene Name: R3H domain containing 2
  ENST ID: ENST00000634871
  CDS Start-End: 195-3095
ggccgtcggggccgagccgcagccgagcggccgtgggcccgggcggcgggcggagacgtgggcgccctccccgccaaggcccgtgcgagaggttagacttgtttcttatatgtgatgccattccagcactggactcatggaggctgagcatttattcaggagtccatagaggccactgtattctattgaagaacatgtctaacagtaacactactcaagagaccctggaaataatgaaagaatcagaaaaaaaactggtggaagaatctgtaaacaaaaacaagtttatatctaagactccaagtaaggaagaaattgagaaagaatgtgaagataccagtttgcgtcaggagacacaggattatgagttcctttttgacaagaggcggacatctaaccatggtcatgccaggaaaagagccaagtctaattccaagctaaagttggtgcgtagcctggcagtgtgtgaggagtcctccaccccatttgctgatgggccattagaaacccaggatataattcaattgcacatcagttgcccttctgacaaggaggaagaaaagtccacaaaagatgtctctgaaaaggaagacaaggacaaaaacaaagaaaagatcccaaggaagatgctgtccagagactccagccaggaatatacggactccactggaatagacctacatgaatttcttgtaaatacactgaaaaagaacccaagggacagaatgatgctgctaaaattagaacaggagattctggaatttattaatgacaacaataatcagttcaagaagttccctcagatgacctcatatcaccggatgctattacaccgggtagctgcctattttgggatggaccacaatgttgatcaaactgggaaagctgtcatcatcaacaaaactagtaacacaagaatccctgaacagaggttctcagaacatataaaggatgagaagaatacagaatttcaacagaggttcattctcaagagagatgatgccagtatggaccgagatgataaccagactggccagaacggatatctaaatgacatcagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtatggcactaggtgccccagaagtgtgcaaccaggtcacctcatcccagtctgtccgggggcttctcccttgtactgcccagcagcaacagcagcagcagcagcagcaacttcctgctctcccacccacgcctcagcaacagccacccttgaataatcacatgatctcacaggcagatgacctcagcaacccctttggacaaatgagccttagtcgccaaggttctactgaagcagctgacccatctgcagctctattccagaccccacttatctcccagcaccctcagcagactagcttcatcatggcttccacgggtcagcccctccccacttccaactattccacctctagccatgcaccacctactcagcaagttctgccaccccaggggtacatgcagccccctcaacagatccaggtttcttactatccccctggacaatatcctaactccaaccagcaatatcgacctctctctcacccggtggcctatagcccccaacgtggtcagcagctgcctcagccatcccagcagcctggtttacagcccatgatgcctaaccagcagcaggcggcttaccaaggcatgattggggtccagcagccacagaaccagggcctgctcagcagccagaggagcagcatggggggccagatgcaaggcctggtggttcagtacactccactgccttcttaccaagttccagtgggtagtgactcgcaaaatgtggtccagccgcctttccagcaacccatgctggtccctgtgagccagtctgtgcaaggaggcctcccagcagcgggggtaccagtgtactatagcatgatcccacctgctcagcagaacggtacgagcccttctgtagggtttctgcaaccccctggctctgagcagtaccagatgcctcagtctccctctccctgcagtccaccacagatgccacagcagtactcaggagtgtcaccttctggaccaggtgtagtggtcatgcagctgaatgtccctaatggaccccagccccctcagaacccatccatggtccagtggagtcattgtaaatactacagcatggaccagcgggggcagaagcctggagacctgtacagtcctgacagcagcccccaggccaacacacaaatgagcagcagccctgtcacatctcctacccagtctccagcaccctctcctgtcaccagcctcagcagtgtctgcacaggactcagtcccctgcctgtcctcacacagttcccccggcctgggggtccagcacagggtgatgggcgctactcccttttgggccagccattacagtacaatctgtccatctgccctcccttgctccatggccagtcaacttacacggtgcaccagggacagagtggactgaagcatggaaaccggggcaagagacaagcactcaaatctgcctccactgacctggggacagcagatgttgtcctggggcgggtgctggaggtgacagatctccctgagggcatcacccgtactgaggcggacaaactcttcacgcagctcgccatgtctggcgccaagatccagtggctcaaggatgctcaggggctgcctggagggggtgggggggacaacagtgggactgctgagaatggccgccactcggacctcgctgccttgtacaccattgtggctgtgttccccagccccctggctgcccaaaatgcctcccttcgtctcaacaactccgtgagtcgcttcaaacttcgaatggccaaaaagaactatgacctgaggatcctggagcgagccagctcccaataaatggaggaggggaaagggactgtcacagaaggagcaagggcagggtggagggggttgaaggatcctgacagaccatggacagaggcaggaagtaaggaaactgatgttaaactggaacctaagacagtgatgaagatggaaacacagatacctacactggcattggactccttcttgctcccctgccatgggtcctctctttttccctggttgaccccccttgcatcactcttcttcccatcctcttctttttttttttttttttttttttgagacggagtttcgctcttgtcaccccagctggagtgcagtagcacgatcttggctaactgcaacctccagctcctgggttcaggtgattctcctgcctcagcctcccaagtagctggcactacagacacgcgccaccatgcccggctaatttttgtatttttagtagagacggagtttcaccatgttggccaggctggcctcaaactcctgacctcaggtgatccacctgccttggccttccagagtgctgggattacaggcgtgagccactgtgcctggcttccatcctcttctatcatttttttaaatctcttctcctatcataaaattaatttctcattttttggtcaggtagaattgggaaagtcccacactgtcctcctattaccttaacatcccaagcttcctttccttttttggtctttatgaatatatttatatggacagaattaagataaacaaaattgattgccccattctctcacttccccatcttgtcttcctagaccccacagagttaaaacttgggattcccctggcccccccagaacacttgtatattgtttgtttgaggttcgtgccgcagtaacagacacagtatttaattgcacatacagatgtttgctgggtatattcactgtaaattttatttaatctgtttttttgtttgtttgggggttatttggggggaggttggttttgtttttaaatataaaaaaaaaaa

SEQ ID NO: 172918 - DNA, 1815 bp, Homo sapiens
  Payload ID: 13982
  Gene Symbol: R3HDM4
  Gene Name: R3H domain containing 4
  Uniprot ID: Q96D70
  ENST ID: ENST00000361574
  CDS Start-End: 75-881
cgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgctgccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacacccagtacctcctgaccctgctggagacagacgggggcctgcctggcctggaggatggggacttggcaccccctgcatcaccaggcatctttgccgaggcctgcaacaacgccacctatgtggaggtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagcgcagccgcatccccatggaaacgctggagacctgggaggagcggctgcttcggttcttctccgtgtccccccaggccgtgtacacagcaatgctagacaacagcttcgagaggcttctgctgcacgctgtctgccagtacatggacctcatctcggccagtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctctggc

SEQ ID NO: 172919 - DNA, 1765 bp, Homo sapiens
  Payload ID: 13982
  Gene Symbol: R3HDM4
  Gene Name: R3H domain containing 4
  ENST ID: ENST00000587975
  CDS Start-End: 89-832
cccctgcccgcctccgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgctgcggaaacagcacttcatcaaccaggcagtgcggaactcagacctcgtgcccaaggccaaggggcggaagagcctccagcgcctggagaacacccagtacctcctgaccctgctggagacagacgggggcctgcctggcctggaggatggggacttggcaccccctgcatcaccaggcatctttgccgaggcctgcaacaacgccacctatgtggaggtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagcgcagccgcatccccatggaaacgctggagacctgggaggagcggctgcttcggttcttctccgtgtccccccaggccgtgtacacagcaatgctagacaacagcttcgagaggcttctgctgcacgctgtctgccagtacatggacctcatctcggccagtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctctgg

SEQ ID NO: 172920 - DNA, 1704 bp, Homo sapiens
  Payload ID: 13982
  Gene Symbol: R3HDM4
  Gene Name: R3H domain containing 4
  ENST ID: ENST00000589428
  CDS Start-End: 89-382
cccctgcccgcctccgggcgcccgtcacttcctgcccggcccggtgaaggccctgccgggcggcggcggcggcgacagcgtgcgagccatggtcgcgctggagaaccccgagtgcggcccggaggcggcggagggcaccccgggcgggcggcggctgctgccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacagtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagcgcagccgcatccccatggaaacgctggagacctgggaggagcggctgcttcggttcttctccgtgtccccccaggccgtgtacacagcaatgctagacaacagcttcgagaggcttctgctgcacgctgtctgccagtacatggacctcatctcggccagtgctgacctggaggggaagcggcagatgaaggtcagtaatcggcacctggatttcctgccgccggggctgctcctgtccgcctacctggagcagcacagctgatggcggccccgcggagaccccgctgccacctcgcccagccatcaagccctccgataccttcggctaaaatatctttcatatttttagaatttgtcctcggaaacctttttcgcttggggtggtctctctcactctgccccctcctcacgcagctcttggcagtcaacagacgctggcggctggggctgcccatgccatcccagctccaagcttcccactccgggacttgtgtttgggtggggagacctgacctgggcatgttcctgtttcttcatcgttgagcttttctggcccggtctgaagctcaagtgaggagggggaggctgggtttttatcacttttaatgaatttggtgtgatttgttgtagatttttaaatttcccttttggagagaaaaaccaaaaaaactcgccccactggtaaaacatgggtcttggtcccagcccctgctcagcccctcccagtttttagcttgaatgagggtggggtctctgggaccctgcccctcatgccagaagcatcttgtgttgtatatgtgtgcgcgcgtgtgccctgagacccaggacagaagccacggtcctaagagccggttttatcctcgtcattctgcgtgtcctcccccacgccacctgtgtcggggctcagggtctcctgctttatatgagcccccttcctttcctcccctcctttatgctgggggtccaggacttccagccagaagcctctgcccttgcactaccttgtctgtcaccccatcccgtgtcccctcgtcccccagcctgactcctgcctgatagctcctgtgtccccatgctggtcctcctggcccaggctgcaggagccaggctggggggcctccgcacccccttgctgcgtgtgggtaattgtgttttgggggaaagtggggaatttaataaatttctggtgctctggc

SEQ ID NO: 172921 - DNA, 1006 bp, Homo sapiens
  Payload ID: 13982
  Gene Symbol: R3HDM4
  Gene Name: R3H domain containing 4
  ENST ID: ENST00000590454
  CDS Start-End: 48-185
cggtgaaggccctgccgggcggcggcggcggcgacagcgtgcgagccatggtcgcgctggagaaccccgagtgcggcccggaggcggcggagggcaccccgggcgggcggcggctgcttcttgctctgttgcccaggctggagtgcagtggtgccatcatgccaacctcgacctcctggacttaagtgatcctcctgcctcaggcccctgagtagctgggactacagtcttgctatgttgctcaggctggtcttgaacccctgagctcaagtgatccaccggcctcagcctcccacaatgctgggatcaccggcatgagccaccacacccagcccgtcttcacaattgtatctgcttcctgtgatgtgaggatgaaacaaaataggattttaagggcccaggacttcacacaccgtaggggtgagctctccattgctgggggaaaccaagcgggccatggctgtggtagggcccttctcggagatcctggccggccttgaccctgaggaccacccctgccccggcccacaggccccttcccagctgcctgcctgccctagccagctcccaggtgaagagactctcggcttccaggcggaaacagcacttcatcaaccaggcagtgcggaactcagacctcgtgcccaaggccaaggggcggaagagcctccagcgcctggagaacacccagtacctcctgaccctgctggagacagacgggggcctgcctggcctggaggatggggacttggcaccccctgcatcaccaggcatctttgccgaggcctgcaacaacgccacctatgtggaggtgtctggaacgatttcatgaaccgctccggggaggagcaggagcgggttcttcgctacctggaggatgagggcaggagcaaggcgcggaggaggggccctggccgtggggaggaccggaggagagaggaccccgcctatacaccccgcgagtgcttccagcgcatcagccggcgtctgcgagccgtcctcaagc

SEQ ID NO: 172922 - DNA, 138 bp, Homo sapiens
  Payload ID: 13982
  Gene Symbol: R3HDM4
  Gene Name: R3H domain containing 4
  ENST ID: ENST00000626716
  CDS Start-End: 1-138
atggtcgcgctggagaaccccgagtgcggcccggaggcggcggagggcaccccgggcgggcggcggctgcttcttgctctgttgcccaggctggagtgcagtggtgccatcatgccaacctcgacctcctggacttaa

SEQ ID NO: 172923 - DNA, 1377 bp, Homo sapiens
  Payload ID: 13983
  Gene Symbol: R3HDML
  Gene Name: R3H domain containing-like
  Uniprot ID: Q9H3Y0
  ENST ID: ENST00000217043
  CDS Start-End: 173-934
tgggcatctggaccagagctgcatctggaggtctttgccaagttcccaggaggcagcatcctctgggtcggcactgttggagaacgctcagggtctggtgctctcgtgcctgccccttccaggcagccggctctgattgcacaaggcagacctgtgactcctccatccagctatgcccctgctgcccagcaccgtgggcctggcaggcctgctcttctgggctggccaggcagtgaacgccttgataatgcctaatgctaccccagccccggcccagcccgagagcacggctatgcggctcctgagtggcctggaggtgcccaggtaccgccggaagcgccacatctctgtgagagacatgaatgccttactggattatcacaaccacatccgggccagtgtgtacccacctgccgccaacatggaatacatggtctgggacaagcggctggccagggctgccgaagcctgggccacccagtgcatctgggcacatgggccttcacagctgatgagatacgtgggccagaacctctccatccattctggccagtaccggtccgtagtggatctcatgaagtcctggtctgaggagaagtggcattacttgtttccggccccaagggactgtaacccacactgcccctggcgctgcgatggccccacctgctcccattatacccagatggtgtgggcatcctccaatcggctgggctgtgccatccacacctgtagtagcatcagtgtctggggcaacacctggcatcgggcggcatacctggtctgcaactatgccattaagggcaactggattggcgagtccccgtacaagatgggaaagccgtgctcctcctgtccccccagttatcaaggcagctgcaatagcaacatgtgcttcaaggggctgaaatccaacaagttcacgtggttctgaattttctctgggctttggtgcgcctccagctgggcctgaccctccatgtcctgccctcaaaaaactgggtggagaaataattgtttctttaaaggatatgagttagaatcaccccctgttgaattttccctcctagatccccttcttaaatgtccaacatgggtcaaaagaaaatgacctccttgccttccttctttcctagttgcatctttcttttcttgggcctctgggaaagagccctgcatctttcattaattcggttctcagagaaccaaggctggaaggcatagaactggcaccttgggaccaggcataatggctcacacctataatcccagtattttgggaggctgaggtgggagaatcacttgagtcctggagttggagaacagcctggaaagcctggcgataccccatctctatttagaaacaaacaaacaaac

SEQ ID NO: 172924 - DNA, 821 bp, Homo sapiens
  Payload ID: 13984
  Gene Symbol: RABAC1
  Gene Name: Rab acceptor 1 (prenylated)
  Uniprot ID: Q9UI14
  ENST ID: ENST00000222008
  CDS Start-End: 99-656
acgtcgactccgctgggtggggccggcgtcgggcggggccggcggggtcttcagggtaccgggctggttacagcagctctacccctcacgacgcagacatggcagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggccgagaggtgagcccagcgcatcagtatgctctggctggaggcatctccttccccttcttctggctggctggtgcgggctcggccgtcttctgggtgctgggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaata

SEQ ID NO: 172925 - DNA, 530 bp, Homo sapiens
  Payload ID: 13984
  Gene Symbol: RABAC1
  Gene Name: Rab acceptor 1 (prenylated)
  ENST ID: ENST00000601028
  CDS Start-End: 1-330
ggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtgccgagaggtgagcccagcgcatcagtatgctctggctggaggcatctccttccccttcttctggctggctggtgcgggctcggccgtcttctgggtgctgggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcagg

SEQ ID NO: 172926 - DNA, 728 bp, Homo sapiens
  Payload ID: 13984
  Gene Symbol: RABAC1
  Gene Name: Rab acceptor 1 (prenylated)
  ENST ID: ENST00000601078
  CDS Start-End: 388-663
ccagcagaaagatgccgaggcggaagggctgagcggcacgtgagcgagctggctctaggccctcggaccagagacccgggagtccgggcccccggccccctcctccctcctccctcgagagcctggagtcccagccccgagccgcagaagtgttggccccggaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggccgagaggtgagcccagcgcatcagtatgctctggctggaggcatctccttccccttcttctggctggctggtgcgggctcggccgtcttctgggtgctgggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgc

SEQ ID NO: 172927 - DNA, 653 bp, Homo sapiens
  Payload ID: 13984
  Gene Symbol: RABAC1
  Gene Name: Rab acceptor 1 (prenylated)
  ENST ID: ENST00000600292
  CDS Start-End: 1-448
agatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggccgagaggtgagcccagcgcatcagtatgctctggctggaggcatctccttccccttcttctggctggctggtgcgggctcggccgtcttctgggtgctggattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaata

SEQ ID NO: 172928 - DNA, 628 bp, Homo sapiens
  Payload ID: 13984
  Gene Symbol: RABAC1
  Gene Name: Rab acceptor 1 (prenylated)
  ENST ID: ENST00000601891
  CDS Start-End: 8-463
cgcagacatggcagcgcagaaggaccagcagaaagatgccgaggcggaagggctgagcggcacgaccctgctgccgaagctgattccctccggtgcaggccgggagtggctggagcggcgccgcgcgaccatccggccctggagcaccttcgtggaccagcagcgcttctcacggccccgcaacctgggagagctgtgccagcgcctcgtacgcaacgtggagtactaccagagcaactatgtgttcgtgttcctgggcctcatcctgtactgtgtggtgacgtcccctatgttgctggtggctctggctgtctttttcggcgcctgttacattctctatctgcgcaccttggagtccaagcttgtgctctttggagccaccctggtggtcatcggctcccacgctgccttccaccagattgaggctgtggacggggaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaata

SEQ ID NO: 172929 - DNA, 2088 bp, Homo sapiens
  Payload ID: 13985
  Gene Symbol: RABGGTA
  Gene Name: Rab geranylgeranyltransferase, alpha subunit
  Uniprot ID: Q92696
  ENST ID: ENST00000216840
  CDS Start-End: 308-2011
acacgcacgctacagtcgcccgtgcgcactcgtacacaccaggtggctaacaggtacgaggcgtttccggacagcgagcgcagagcccccgcgcacgcgcctccgagccggcctcttccgccgcaagtccctccccaagcctgcagagtgcgctgcgtttcgatgagccgggacgtggcgccgctctagccagcgcctgggctctgtggcgggcgccgcagctccgcgtcccccgcgcctcctcccagcgcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 172930 - DNA, 2265 bp, Homo sapiens
  Payload ID: 13985
  Gene Symbol: RABGGTA
  Gene Name: Rab geranylgeranyltransferase, alpha subunit
  Uniprot ID: Q92696
  ENST ID: ENST00000399409
  CDS Start-End: 485-2188
ctgcagagtgcgctgcgtttcgatgagccgggacgtggcgccgctctagccagcgcctgggctctgtggcgggcgccgcagctccgcgtcccccgcgcctcctcccagcgcaggtgggtccgcccgcggggggcgggggtgcccgggagccgtgggacgggcgggtagcggcaacctttggggagcagagtggtccccaacgcccaggtgccccggctcgcgctctggcccgggcgaatcgggctataggaagggccacacggatggaagtcctagtccgggtgctcacctcttgtggaacgtgcaaagcctgtcccaggacctctttacactctgggggtctctgcccaggcacgcttgctgcttccggacacagctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 172931 - DNA, 573 bp, Homo sapiens
  Payload ID: 13985
  Gene Symbol: RABGGTA
  Gene Name: Rab geranylgeranyltransferase, alpha subunit
  ENST ID: ENST00000560127
  CDS Start-End: 107-328
ctctgtggcgggcgccgcagctccgcgtcccccgcgcctcctcccagcgcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctag

SEQ ID NO: 172932 - DNA, 704 bp, Homo sapiens
  Payload ID: 13985
  Gene Symbol: RABGGTA
  Gene Name: Rab geranylgeranyltransferase, alpha subunit
  ENST ID: ENST00000560243
  CDS Start-End: 1-411
cagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggaccctccaccccgaacaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggcta

SEQ ID NO: 172933 - DNA, 1197 bp, Homo sapiens
  Payload ID: 13985
  Gene Symbol: RABGGTA
  Gene Name: Rab geranylgeranyltransferase, alpha subunit
  ENST ID: ENST00000560777
  CDS Start-End: 620-1150
cgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgagtcctgcagcttttgtcaagagcactgtgggactgtgggcctggtgctgatggggctgaagtctttgtcctttgtgccaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaata

SEQ ID NO: 172934 - DNA, 1883 bp, Homo sapiens
  Payload ID: 13985
  Gene Symbol: RABGGTA
  Gene Name: Rab geranylgeranyltransferase, alpha subunit
  ENST ID: ENST00000558376
  CDS Start-End: 118-1392
cagcgcctgggctctgtggcgggcgccgcagctccgcgtcccccgcgcctcctcccagcgcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggcaagccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggaga

SEQ ID NO: 172935 - DNA, 680 bp, Homo sapiens
  Payload ID: 13985
  Gene Symbol: RABGGTA
  Gene Name: Rab geranylgeranyltransferase, alpha subunit
  ENST ID: ENST00000560521
  CDS Start-End: 1-527
agtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaacccagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagaggccctctcaggctaccaa

SEQ ID NO: 172936 - DNA, 1963 bp, Homo sapiens
  Payload ID: 13985
  Gene Symbol: RABGGTA
  Gene Name: Rab geranylgeranyltransferase, alpha subunit
  ENST ID: ENST00000559974
  CDS Start-End: 197-1471
cagcgcctgggctctgtggcgggcgccgcagctccgcgtcccccgcgcctcctcccagcgcaggcacgcttgctgcttccggacacagctgtgggcggagctagtaggggcggggctacgtgattgacacttctctcctcagacttcaagggctaccactggacccttcccctgtcttgaaccctgagccggcaccatgcacggacgcctgaaggtgaagacgtcagaagagcaggcggaggccaaaaggctagagcgagagcagaagctgaagctataccagtcagccacccaggccgtattccagaagcgccaggctggtgagctggatgagtccgtgctggaactgacaagccagattctgggagccaaccctgattttgccaccctctggaactgccgacgagaggtgctccagcagctggagactcagaagtctcctgaagagttggctgctctggtgaaggcagaactgggcttcctggagagctgcctgcgggtgaaccccaagtcttatggtacctggcaccaccgatgctggctgctaggccgcctgcctgagcccaactggacccgagagctggagctctgtgcccgtttcctggaggtggatgagcggaactttcactgctgggactatcggcggtttgtggccacacaggcagccgtgccccctgcagaagagctagccttcactgacagcctcatcacccgaaacttctccaactactcttcctggcattaccgctcctgtctcttgccccagctgcacccccagccggattctggaccacaggggcgcctccctgaggatgtgctgctcaaagagctggagctggtgcagaatgccttcttcactgaccccaatgaccagagtgcctggttttatcaccgttggctcctaggccgagctgacccccaggatgcactgcgctgcctgcatgtgagccgggacgaggcctgtctgactgtctccttctctcggcccctcttagtgggctccaggatggagatcttgctgctcatggttgatgattctcccctgattgtggagtggaggaccccagatggcaggaaccggcccagccatgtctggctctgtgacctgcctgctgcctccctcaacgaccagttgccccaacatacatttcgcgtcatttggacagcaggcgatgtccagaaagaatgcgtgcttttaaaaggccgccaggagggctggtgccgggactccacgacagacgagcagctattcaggtgtgagctgtcagtggagaagtccacagtgctgcagtctgagctggaatcctgtaaggagctgcaggagctggagcctgagaataaatggtgcctgcttaccatcatcctgctgatgcgggcactggaccccctgctgtatgagaaggagaccctgcagtacttccagaccctcaaggcaagccgtggaccccatgcgggcaacgtatctggatgacctgcgcagcaagttcttgctggagaatagcgtgctcaagatggagtatgccgaggtgcgtgtgctgcacctggctcacaaggatctgacagtgctctgccatctggaacagctgctcttggtcacccatcttgacttgtcacacaatcgcctccgaaccctgccacctgcactggctgccctgcgctgccttgaggtgctgcaggccagtgataatgccatagagtccctggacggcgtcaccaacctaccccggctgcaggagctgctactgtgcaacaaccgcctccagcagcctgcagtgctccagcctcttgcctcctgccccaggctggtcctcctcaacctgcagggtaacccgctgtgccaagcggtgggcatcttggagcaactggctgaactgctgccttcagttagcagcgtcctcacctaagaggccctgccccctacccttgccctttaacttattgggactgaataaagaatggagag

SEQ ID NO: 172937 - DNA, 1496 bp, Homo sapiens
  Payload ID: 13986
  Gene Symbol: RABGGTB
  Gene Name: Rab geranylgeranyltransferase, beta subunit
  Uniprot ID: P53611
  ENST ID: ENST00000319942
  CDS Start-End: 72-1067
gcatctgcgcaggcgcccggctcctaagtctacccaggaactgaccctgctctctcctttccctgttagacatgggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggagaaattgacacaagattctctttttgtgcggtggcaactttggctttgttggggaagcttgatgctattaatgtggaaaaggcaatcgaatttgttttatcctgtatgaactttgacggtggatttggttgcagaccaggttctgaatcccatgctgggcagatctattgttgcacaggatttctggcaattacaagtcagttgcatcaagtaaattctgatttacttggctggtggctttgtgaacgacaattaccctcaggcgggctcaatggaaggccggagaagttaccagatgtatgctactcatggtgggtcctggcttccctaaagataattggaagacttcattggattgatagagagaaactgcgtaatttcattttagcatgtcaagatgaagaaacggggggatttgcagacaggccaggagatatggtggatccttttcataccttatttggaattgctggattgtcacttttgggagaagaacagattaaacctgttaatcctgtcttttgcatgcctgaagaagtgcttcagagagtgaatgttcagcctgagctagtgagctagattcattgaattgaaagttgcatagtatagttttgccattttaacatttctgtatttgaagtgcttatcgaatctaaaagtgactactgttaatattttgtatattgtgttaaattaattttaataaattatataattatacatattgtaaaataaagaccggtattttattttctgctttttattctgaagtcctgttattctgactacagttctttgtgtatacttctgtgtctgttatgttcaataactgagctaacataaaataactctaggtttctacttgatttttcccccatgtatacctttcatctgttctatagcaagttgatgtaaattggtttgtcaacaagaatgttaactgatgaaagtggatagaacccatacatgaattaaatgatgcacaaaataaatggctgttgaaatttg

SEQ ID NO: 172938 - DNA, 512 bp, Homo sapiens
  Payload ID: 13986
  Gene Symbol: RABGGTB
  Gene Name: Rab geranylgeranyltransferase, beta subunit
  ENST ID: ENST00000370826
  CDS Start-End: 42-500
tacccaggaactgaccctgctctctcctttccctgttagacatgggcactccacagaaggatgttattatcaagtcagatgcaccggacactttgttattggagaaacatgcagattatatcgcatcctatggctcaaagaaagatgattatgaatactgtatgtctgagtatttgagaatgagtggcatctattggggtctgacagtaatggatctcatgggacaacttcatcgcatgaatagagaagagattctggcatttattaagtcttgccaacatgaatgtggtggaataagtgctagtatcggacatgatcctcatcttttatacactcttagtgctgtccagattcttacgctgtatgacagtattaatgttattgacgtaaataaagttgtggaatatgttaaaggtctacagaaagaagatggttcttttgctggagatatttggggtaatgtcagatttagtccattctacccaaaataccaatattaaaatgtactggtt

SEQ ID NO: 172939 - DNA, 4997 bp, Homo sapiens
  Payload ID: 13987
  Gene Symbol: RABGAP1
  Gene Name: RAB GTPase activating protein 1
  Uniprot ID: Q9Y3P9
  ENST ID: ENST00000373647
  CDS Start-End: 135-3344
ggggacagggcggtttgggaggcccaggcggcggagcctccgggacggcgagcggcgggcggcggaggaggagacggcaggtcgggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaagattgtagggaatggaagtgaacagcagctgcaaaaagagctagcagatgtactgatggatcctccaatggacgaccagccaggggaaaaggagcttgtgaaaaggtcacaactggatggtgaaggagatgggcctctttctaatcagctctccgcttcatccaccattaaccctgtgccattagtagggctccaaaaaccagagatgagcctaccagtgaaacctggacaaggagattctgaagcttcaagtcctttcacaccagtggccgatgaggacagcgtagttttcagtaaactgacttacttaggctgtgcctcggtaaatgctcccaggagtgaagtggaagccttaaggatgatgtccatcttaagaagccagtgtcagatttcactagatgttaccctttcagtgccgaatgtgtctgaaggaattgtgagactcttagatcctcagacaaacactgaaatagcaaactaccctatctacaaaatcctcttctgtgtcagagggcatgatggaactcctgagagtgactgttttgctttcactgaaagtcattacaatgcagagctcttcagaatacacgtcttccggtgtgaaatacaagaagctgtaagccggatactttacagttttgccactgccttccgccgttctgccaagcagaccccactttcagccactgctgcaccccagactcctgacagtgacatctttaccttctctgtgtctttagaaataaaagaagatgatggtaaaggttattttagtgcagttcccaaagataaggacagacagtgctttaaactacgccaaggaattgataagaagattgtcatctatgtgcagcaaacaactaataaagaacttgccattgaaaggtgttttggtcttctccttagtccaggaaaagatgtacgaaatagtgacatgcacttattagatttggaatctatgggcaaaagttcagatggaaagtcgtatgttattacggggagctggaatccaaaatccccacattttcaagttgtaaatgaagaaactcctaaagataaagtcctgtttatgaccacagctgtagatttggtaataacagaagtacaggagcctgttcgatttctcctggagacaaaagtccgcgtttgctcacctaatgaaagattattctggcccttcagcaaacgtagtactactgaaaatttctttttgaaactaaaacagataaagcaaagggagagaaagaataatactgacactttatatgaagttgtatgcttggaaagtgaatcagaaagagagaggaggaaaactacagccagtccttcagttcgcctgccacagtctggatcgcaaagttcagtgataccttctcctccagaagatgatgaagaggaagataatgatgaacctctcctgagtggatctggtgatgtatccaaagaatgtgcagaaaaaattcttgaaacatggggagaactgttgtcaaaatggcatctcaacttgaatgtgagaccgaagcagttgtcatccttagtaagaaacggtgtccctgaagctcttcgaggagaagtctggcagctgctagcaggctgtcataacaatgaccacctggtagagaaataccgcattcttatcacaaaggagtctccccaggacagtgctatcacccgggatattaaccgaacattcccagcccatgactactttaaggacacaggaggagatggacaagattccttatataaaatatgcaaggcttattctgtgtatgatgaagagattggttattgccagggccagtcatttcttgctgctgtgctccttctccatatgcctgaagaacaggcattcagtgttctggtcaagatcatgtttgactatgggctcagggaacttttcaagcaaaacttcgaagatttgcattgcaaattttaccagttggagcgcctcatgcaggaatacattcctgacctgtacaaccacttcctggatataagccttgaagcacacatgtatgcctcccagtggtttcttactcttttcactgcaaaattccctctctacatggtcttccatatcatcgacctgcttttatgtgagggaataagtgttatttttaatgtcgcccttggattattaaagacttcgaaagatgacctgctgttgacagactttgaaggtgccttgaagttctttagggttcagcttcctaagagataccgctcagaagaaaatgcaaaaaaactaatggaattagcctgcaacatgaagattagtcagaagaagttgaaaaaatacgagaaagaatatcacaccatgagggaacagcaggcccagcaagaagaccccatcgagcgatttgagcgggagaataggcgtctacaagaagctaacatgaggttggaacaggaaaacgatgacttagcccatgagctggtgaccagcaagattgcactacggaaggacctggataacgctgaggaaaaggcagatgctctgaataaggagctgctgatgaccaaacagaagttgattgatgcagaagaagagaaaagacggctggaagaagagtctgctcagttaaaagaaatgtgccgtcgggaactcgacaaggcagaatctgagattaaaaaaaacagttctatcattggtgactataagcagatttgttctcagttgagtgaaagattggagaagcagcagacagccaataaggtggaaattgagaaaattcggcaaaaagtggatgactgtgagcggtgccgggaatttttcaacaaagaagggcgtgtaaaaggcataagctcaaccaaggaggttttagatgaggacacggatgaagagaaagagacgctcaagaaccagctgagagaaatggagctagaactggcacagaccaaactccagctggtggaggccgagtgtaagatacaggacttggaacaccatttagggcttgccctcaatgaggtgcaggcagccaagaagacgtggtttaaccgaacactgagctccataaagacagcaaccggggttcaagggaaagagacttgctgagagcagctgccgcctcccgacaccttcagaaaacacgacaccttttgttgccttctttggccagatgtgtgattctgtgacttgtcccaggaccagaatgtacctaagtcagatccatagacgcatgttggtaggtcactggaccagagcttgtgaagcaggcaacctctggggtaagactactgatactaacaggcctgctagctcagccgacgctctggacactctagaaatcactcctcagtgtgacctcccaggcctcttccccgtgtacgtcaacacctcacccagcctaaaggctgagtttacatgatcagagttaggggatccttcagtctgttgattttttttctaaaccttttttttttaatatacatatatatatatatatatatatatatatatatatatatatatatatatagtgggggtggggcaagggatcagaaattcaaataattcttttctgcttcaatgccagcagaaggtcccccaggtagacatggagaagcactttgttttaaataggagggtttcatagttgcatctgaagccacctggttctgttaaactgtatggtgcaggttttgggtttggcattattcatgtttctgatcaattctatgcaactctcatagttcctgttactttttagcattagctgccaaatgacttcaaaaggctggggtgggtgacttgactgtgagactggattataacatggacaaatcttattttgcttaatgtgtttgtgtgtgtgtgtgtgtgtgtgtgtgtgtgtgtatgtatatatatatataaatatctttcccaatatgccccgttgacagtgtttaaattccagactaggactgctgatctgcacaatttaattatgtggttattcgagcacttaatttcactcaaggttcattgggctctgctctcctccctgccattacgggagctgtggacagagctccctcacttcaagattcctagtgtttttgcacaacaggttgtccaagtgagaaagactgagttgcgtgtctgtaaatgtctgcgcagggtgcacatgctgcgaggtctccatcctccgggcctgtccctcccagatgggctgggcctttgggccctcctcagagtatgcctgggtacaaacctcactgttcagatgggctgtaagttctcacttcaaagctatggaatggattttagcacctttaaaaaaaaaaaaaactttgacttttaatttatatagtgatatgctgacaggctgacacgcagatggttttgtcctcttttctgcgttcagtgttgaggcggctgcttacaagaggcactggttttgtatataaagacactcgggttgttttgtagctctttttcttattggctgtactaacgcttgctgaggttatctgtaataagggaggtaacaagtggcaaccccctccccaccaaccatcccctttgctgctttctgtgtctttcttgttcagttaccaaaatagctgtaagcctatctaatgctaggtgtgtggacattgtgctaaggtagtttcagtgtgtcaactttatgaattgaaatataaaccagtaaaattgtattactgtttcttttgttggttttattttaacagcatattgattaaatattttggtacaaacaaa

SEQ ID NO: 172940 - DNA, 543 bp, Homo sapiens
  Payload ID: 13987
  Gene Symbol: RABGAP1
  Gene Name: RAB GTPase activating protein 1
  ENST ID: ENST00000402311
  CDS Start-End: 207-543
caggcggcggagcctccgggacggcgagcggcgggcggcggaggaggagacggcagactgaccaaatatggaagtgtgcaagtcttgaacacattagtttatacaatgtggcctgaaagtttccctcctctttccaaatcaaccataatattctgaggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaagattgtagggaatggaagtgaacagcagctgcaaaaagagctagcagatgtactgatggatcctccaatggacgaccagccaggggaaaaggagcttgtgaaaaggtcacaactggatggtgaaggagatgggcctctttctaatcagctctccgcttcatccaccattaaccctgtgccattagtag

SEQ ID NO: 172941 - DNA, 3897 bp, Homo sapiens
  Payload ID: 13987
  Gene Symbol: RABGAP1
  Gene Name: RAB GTPase activating protein 1
  Uniprot ID: Q9Y3P9
  ENST ID: ENST00000456584
  CDS Start-End: 607-2406
agtcctgaggcgggctgaaagcccaggtggggctcggagaagaggaagctccgcctcgcttcccggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaagagccagtgaaattaaaagtgcagcagatatgttaaacagcaaattacacatggctgaagagagaatcaaatacctggaaaatggatctgaagaaattatccagaagatagcattgaaagatatgaaagaccacttaagagacatgaaaattaagatgagaaggaccaaccatcttaagtgttctataataagagaatggtgaagatggaagaaaatacttgaagagataatagttgaatattttccagaagtgataaacgatataaatcattggcttcaaagaacacaattgtagggaatggaagtgaacagcagctgcaaaaagagctagcagatgtactgatggatcctccaatggacgaccagccaggggaaaaggagcttgtgaaaaggtcacaactggatggtgaaggagatgggcctctttctaatcagctctccgcttcatccaccattaaccctgtgccattagtagggctccaaaaaccagagatgagcctaccagtgaaacctggacaaggagattctgaagcttcaagtcctttcacaccagtggccgatgaggacagcgtagttttcagtaaactgacttacttaggctgtgcctcggtaaatgctcccaggagtgaagtggaagccttaaggatgatgtccatcttaagaagccagtgtcagatttcactagatgttaccctttcagtgccgaatgtgtctgaaggaattgtgagactcttagatcctcagacaaacactgaaatagcaaactaccctatctacaaaatcctcttctgtgtcagagggcatgatggaactcctgagagtgactgttttgctttcactgaaagtcattacaatgcagagctcttcagaatacacgtcttccggtgtgaaatacaagaagctgtaagccggatactttacagttttgccactgccttccgccgttctgccaagcagaccccactttcagccactgctgcaccccagactcctgacagtgacatctttaccttctctgtgtctttagaaataaaagaagatgatggtaaaggttattttagtgcagttcccaaagataaggacagacagtgctttaaactacgccaaggaattgataagaagattgtcatctatgtgcagcaaacaactaataaagaacttgccattgaaaggtgttttggtcttctccttagtccaggaaaagatgtacgaaatagtgacatgcacttattagatttggaatctatgggcaaaagttcagatggaaagtcgtatgttattacggggagctggaatccaaaatccccacattttcaagttgtaaatgaagaaactcctaaagataaagtcctgtttatgaccacagctgtagatttggtaataacagaagtacaggagcctgttcgatttctcctggagacaaaagtccgcgtttgctcacctaatgaaagattattctggcccttcagcaaacgtagtactactgaaaatttctttttgaaactaaaacagataaagcaaagggagagaaagaataatactgacactttatatgaagttgtatgcttggaaagtgaatcagaaagagagaggaggaaaactacagccagtccttcagttcgcctgccacagtctggatcgcaaagttcagtgataccttctcctccagaagatgatgaagaggaagataatgatgaacctctcctgagtggatctggtgatgtatccaaagaatgtgcagaaaaaattcttgaaacatggggagaactgttgtcaaaatggcatctcaacttgaatgtgagaccgaagcagttgtcatccttagtaagaaacggtgtccctgaagctcttcgaggagaagtctggcagctgctagcaggctgtcataacaatgaccacctggtagagaaataccgcattcttatcacaaaggagtctccccaggacagtgctatcacccgggatattaaccgaacattcccagcccatgactactttaaggacacaggaggagatggacaagattccttatataaaatatgcaaggtatttcatgtcaaaaaaaaaaaggactcaattctgagtggtggttctactttgaaattacataagaaacaactacaaagtgtaatttgtatttgatgttcaagaattccaaaaagagaaaagacattgcaaagtcaaaggcttattctgtgtatgatgaagagattggttattgccagggccagtcatttcttgctgctgtgctccttctccattttaaaatgcttggcaagaataccacacaggtgatgtcagcaaagagttttgagtacctgttatgatctgtactgtgctgaagatcagagatgcctgaagaacaggcattcagtgttctggtcaagatcatgtttgactatgggctcagggaacttttcaagcaaaacttcgaagatttgcattgcaaattttaccagttggagcgcctcatgcaggaatacattcctgacctgtacaaccacttcctggatataagccttgaagcacacatgtatgcctcccagtggtttcttactcttttcactgcaaaattccctctctacatggtcttccatatcatcgacctgcttttatgtgagggaataagtgttatttttaatgtcgcccttggattattaaagacttcgaaagatgacctgctgttgacagactttgaaggtgccttgaagttctttagggttcagcttcctaagagataccgctcagaagaaaatgcaaaaaaactaatggaattagcctgcaacatgaagattagtcagaagaagttgaaaaaatacgagaaagaatatcacaccatgagggaacagcaggcccagcaagaagaccccatcgagcgatttgagcgggagaataggcgtctacaagaagctaacatgaggttggaacaggaaaacgatgacttagcccatgagctggtgaccagcaagattgcactacggaaggacctggataacgctgaggaaaaggcagatgctctgaataaggagctgctgatgaccaaacagaagttgattgatgcagaagaagagaaaagacggctggaagaagagtctgctcagttaaaagaaatgtgccgtcgggaactcgacaaggcagaatctgagattaaaaaaaacagttctatcattggtgactataagcagatttgttctcagttgagtgaaagattggagaagcagcagacagccaataaggtggaaattgagaaaattcggcaaaaagtggatgactgtgagcggtgccgggaatttttcaacaaagaagggcgtgtaaaaggcataagctcaaccaaggaggttttagatgaggacacggatgaagagaaagagacgctcaagaaccagctgagagaaatggagctagaactggcacagaccaaactccagctggtggaggccgagtgtaagatacaggacttggaacaccatttagggcttgccctcaatgaggtgcaggcagccaagaagacgtggtttaaccgaacactgagctccataaagacagcaaccggggttcaagggaaagagacttgctgagagcagctgccgcctcccgacaccttcagaaaacacgacaccttttgttgccttc

SEQ ID NO: 172942 - DNA, 996 bp, Homo sapiens
  Payload ID: 13987
  Gene Symbol: RABGAP1
  Gene Name: RAB GTPase activating protein 1
  ENST ID: ENST00000426918
  CDS Start-End: 54-254
tcgggcattaaaaaatatttaatcattcatgtgttgagactcattcttgagttatggatgacaaggcttctgttggaaaaatcagtgtctcttcagactcagtatctactcttaatagtgaagattttgtcttggtttccaggcaaggagatgagacaccatctacaaataatggaagtgatgatgagaaaacaggactcaagattctgaagcttcaagtcctttcacaccagtggccgatgaggacagcgtagttttcagtaaactgacttacttaggctgtgcctcggtaaatgctcccaggagtgaagtggaagccttaaggatgatgtccatcttaagaagccagtgtcagatttcactagatgttaccctttcagtgccgaatgtgtctgaaggaattgtgagactcttagatcctcagacaaacactgaaatagcaaactaccctatctacaaaatcctcttctgtgtcagagggcatgatggaactcctgagagtgactgttttgctttcactgaaagtcattacaatgcagagctcttcagaatacacgtcttccggtgtgaaatacaagaagctgtaagccggatactttacagttttgccactgccttccgccgttctgccaagcagaccccactttcagccactgctgcaccccagactcctgacagtgacatctttaccttctctgtgtctttagaaataaaagaagatgatggtaaaggttattttagtgcagttcccaaagataaggacagacagtgctttaaactacgccaaggaattgataagaagattgtcatctatgtgcagcaaacaactaataaagaacttgccattgaaaggtgttttggtcttctccttagtccaggaaaagatgtacgaaatagtgacatgcacttattagatttggaatctatgggcaaaagttcagatggaaagtcgtatgttattacggggagctggaatccaaaatccccacattttca

SEQ ID NO: 172943 - DNA, 1595 bp, Homo sapiens
  Payload ID: 13987
  Gene Symbol: RABGAP1
  Gene Name: RAB GTPase activating protein 1
  ENST ID: ENST00000616002
  CDS Start-End: 497-1546
gttctgcagtacgcgggttgaagcacattcctgctttgcaaggctttctgctaaggatgtattgtggcttttgtttggattgcagcatgcagaattacagctgttcagaggagactcattacaactcctgctgaagctcctaatcttcttcccttctcttctaccctttccccctaccctcacttggcctgaagacgttctccccagagtttaccttgctcccctggtgctatgtgtatggtgaacctggcactatggccgcgtctgggactggccagacaactgctgctggctctccttattccaggaaggatttaaaggggaattgcactgcaggcaatgcaccagagcagcagcatcaggagcttggggagtaaggctcctctggcattattacacacatgcaaagctgaccgcaatgacagcagctgcttctttgaactgttggcagcagccaagcggcagcatgaagtgacagatcactcctgagctcaagatgaactccaccttggatggtaatcagagcagccaccctttttgcctcttggcatttggctatttggaaactgtcaatttttgccttttggaagtattgattattgtctttctaactgtattgattatttctggcaacatcattgtgatttttgtatttcactgtgcacctttgttgaaccatcacactacaagttattttatccagactatggcatatgctgacctttttgttggggtgagctgcgtggtcccttctttatcactcctccatcacccccttccagtagaggagtccttgacttgccagatatttggttttgtagtatcagttctgaagagcgtctccatggcttctctggcctgtatcagcattgatagatacattgccattactaaacctttaacctataatactctggttacaccctggagactacgcctgtgtattttcctgatttggctatactcgaccctggtcttcctgccttcctttttccactggggcaaacctggatatcatggagatgtgtttcagtggtgtgcggagtcctggcacaccgactcctacttcaccctgttcatcgtgatgatgttatatgccccagcagcccttattgtctgcttcacctatttcaacatcttccgcatctgccaacagcacacaaaggatatcagcgaaaggcaagcccgcttcagcagccagagtggggagactggggaagtgcaggcctgtcctgataagcgctatgccatggtcctgtttcgaatcactagtgtattttacatcctctggttgccatatatcatctacttcttgttggaaagctccactggccacagcaaccgcttcgcatccttcttgaccacctggcttgctattagtaacagtttctgcaactgtgtaatttatagtctctccaacagtgtattccaaagaggactaaagcgcctctcaggggctatgtgtacttcttgtgcaagtcagactacagccaacgacccttacacagttagaagcaaaggccctcttaatggatgtcatatctgaagtggctcagttacggggttcccgtgtgtgtgtgtgtgtgtgtgtgtgt

SEQ ID NO: 172944 - DNA, 2899 bp, Homo sapiens
  Payload ID: 13988
  Gene Symbol: RABGAP1L
  Gene Name: RAB GTPase activating protein 1-like
  Uniprot ID: Q5R372
  ENST ID: ENST00000251507
  CDS Start-End: 175-2622
ctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggactcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattga

SEQ ID NO: 172945 - DNA, 1744 bp, Homo sapiens
  Payload ID: 13988
  Gene Symbol: RABGAP1L
  Gene Name: RAB GTPase activating protein 1-like
  Uniprot ID: Q5R372
  ENST ID: ENST00000347255
  CDS Start-End: 96-1232
gcacatttggctatttttcaaagagagcatgtagttcaagaaatggcttattttgttttttattcttctttttgtggtctatttaggaaaacaaaatgaaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccaggg

SEQ ID NO: 172946 - DNA, 1880 bp, Homo sapiens
  Payload ID: 13988
  Gene Symbol: RABGAP1L
  Gene Name: RAB GTPase activating protein 1-like
  Uniprot ID: Q5R372
  ENST ID: ENST00000325589
  CDS Start-End: 396-1472
agggaagtgaagccagtaggagactgagagattagaagaacagggcagtagaggatgaatttgcagtgaggttaaaggaacaatttattgggagaagggaatgtaggagggtagaagactttaaaattgaaaagaaataaaaggaggcagggatgtaaaacgagccataagtacaatgacaaatgggcattaaggaggaaaaagactatgtagaagaatctggtaaatatggatattaacagcaataagctcctttttaacgatttaattctaccaagtaaatatttgggattactcgctttttgccttttatttaccaaaaaattcatatattttcaaaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaa

SEQ ID NO: 172947 - DNA, 2605 bp, Homo sapiens
  Payload ID: 13988
  Gene Symbol: RABGAP1L
  Gene Name: RAB GTPase activating protein 1-like
  Uniprot ID: Q5R372
  ENST ID: ENST00000357444
  CDS Start-End: 282-2099
ggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaagcaacagatgaaatttagtcttacaccgagacagactattcacctagttaaatatgaagggtctatgaaggtctccatgacaccctgtaaccagctgcaatttgacattagacttgatgttctgattacttatactttttgttttagttcctttcctgagcctgaattgtacaaatatgtcctaaaacaccaacttattaagaggcttaatgcctgttaaatgcgtcagtgctcttggcagcttagcatgagtgctttctttgcatgggaggttgcagtttagaagcaactttatggatcatttcccaggttgatgttacatatgttcattttacaacctgtgtgcataatctctcagggtgaaggtaattaagagaaagcataatctacagaattgaagccaagtaatctaagattctgtttttaaactctttgctatataacattagttaagttgtttaccctcttaatttatccatttgtaaaatgatagtttttgtttttaaagtgctctattacccttactttaaaagtcctgtctaccatatatttaaaactataagtggaaataatgaagaaactctgaacttgcttttgcttatatatggatatatcatattatatgcctaagattggagataaattttataacctgattttctcatggcagtgtacaaatgaaattattctgtaagtttttcaaaacagtaaaatcactatttttca

SEQ ID NO: 172948 - DNA, 1849 bp, Homo sapiens
  Payload ID: 13988
  Gene Symbol: RABGAP1L
  Gene Name: RAB GTPase activating protein 1-like
  Uniprot ID: Q5R372
  ENST ID: ENST00000367687
  CDS Start-End: 124-1257
gggcacatttggctatttttcaaagagagcatgtagttcaagaaatggcttattttgttttttattcttctttttgtggtctatttaggaaaacaaaatgaaggtggcctttgtctttcagttatggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaa

SEQ ID NO: 172949 - DNA, 1425 bp, Homo sapiens
  Payload ID: 13988
  Gene Symbol: RABGAP1L
  Gene Name: RAB GTPase activating protein 1-like
  Uniprot ID: B7ZAP0
  ENST ID: ENST00000367688
  CDS Start-End: 180-941
aagtatctttgttccattgaatgtttgcggtcacagagagaacttagagttatatgacactcaaaggaaaagcaaaagagcattaagaagtgtctgtttttgttattgccatttcataaatattttagtaggtgttcaatttcattggatattctttttttttaattgtctttgtacctatgattgaaaacagtagttggtctatgacttttgaggagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctca

SEQ ID NO: 172950 - DNA, 6282 bp, Homo sapiens
  Payload ID: 13988
  Gene Symbol: RABGAP1L
  Gene Name: RAB GTPase activating protein 1-like
  ENST ID: ENST00000392064
  CDS Start-End: 56-982
agtctggtctggagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcacttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctg

SEQ ID NO: 172951 - DNA, 1847 bp, Homo sapiens
  Payload ID: 13988
  Gene Symbol: RABGAP1L
  Gene Name: RAB GTPase activating protein 1-like
  ENST ID: ENST00000457696
  CDS Start-End: 102-1847
ggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttagattattggtaattcctattccttttgaatatttcagccctgtgcctaaggatagagataaattttatttcaaattaaagcaaggaatagagaagaaggttgtgattacagtgcagcaactttctaacaaagaattagctattgaaagatgttttggaatgttattaagcccaggtcgaaacgtgaagaacagtgacatgcatttactggatatggaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaag

SEQ ID NO: 172952 - DNA, 6821 bp, Homo sapiens
  Payload ID: 13988
  Gene Symbol: RABGAP1L
  Gene Name: RAB GTPase activating protein 1-like
  Uniprot ID: Q5R372
  ENST ID: ENST00000489615
  CDS Start-End: 402-1514
acacacacacacacacacacacacacacacacacacacacacacacactctcacacattctcacatgctagacccttctaagcagcttgtccgtttttacacatgtatctgaactctcctgcatcactcttggccattttctcgcattcgattgcttttgccgttttttatttagatcagtacttgatttcattttcattttccagtctactttggggttctcgcagtggataatttagccaaaatgtttttcttgtggagacattagctgacaattcccaccacagactggcttgtacgtcctcccagggagacctaaacctggctcccctcccaccgcagttcttaatattgtggataagagatccatctttctcattctggatacctacttagtgctcatggaagaaggggtgccctgcccagccccagctgctaagctcacacctcctgtcaaaaagtcccaggacatgcacgacgagaggagcaagctggtgaatgagtatgcgtgtcgagtgctggaacttctggggatggggcatcgtctgtttgtgcctcggcttctggcgacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacataaaaatggagacatctgttattccaaggttgaagtgataagaagatctttgtcacaggaaaaaaaaaattgaaacctaaacatcttaagttttcaggatttattcagataaagcacactgtggggccaggcatgaccactctcaggtttcctcctgagcctgattcccagggaagtgttaatcctgtccaaaggaaagaaccaatcagcgatcattggtttactttcattttctgttcggtacatctggaaatgaagtgccaggaatagacgggctgttcagattatacgctaggtaaaaggaactgaaattttaataagtgtaggtcaggatcatttgggctgtggtattctaacagatccttttaagaatgccacataggacttgtgagttcctaagtacaccaaagtatggacacagatgtgacttctggcaattataaagttaaaggtggatattgcaccttacagacttagggagcctttaccagagacgcctaaaaagccccaggttcagccattgtgctgaatagagtggaatatagaaccagggacagagtatttcatttaacgttgatatatacttgctaaggaaacactaacaatactgtaactttgttaaaggacatagtattgaaatgggaaatagaggtcaggctcacatcatcttagtttaatgctgggcaactttttctgatttctgtagttccctgaaaatgtgtccttcgtacccataaagagatacaaatgcatttgtaacatttttgattgaatataaaacctttacagaaatacttatctcatggaaaggtaaagctattgtttaaaaattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtggatcacctaaggtcaggagtttgagaccagcctggccaacatggtgaaaccctatctctactgcaaaatacaaaaattagccgggcttggtggcgggtgcctgtaatcccagctactcgggaggttgaggcaggagaatcacttgaacccaggaggcagaggttgcagtgggccaagattacggcattacattccatccagcctgggcgacaagagcaaaattccgtctcgaaaaatcaccaggtacatacctctcaagtttgataagtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcacttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggcagaggagatagagttacatctttaaaggagtgagccagtcacccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattctgttgtatgatttgaacactattaggtttgtatgtgtgtttaattggaagaattttatatagagtatctctgctgcttttgtttacctgggtaccacacaaccaaatacacattgagatttcaagaaatgatgatgaaagccagaaggccagaccacagctctgcagcctgtttcctacaaccagatataaaactctttctcgtcgccatgctgatagtcacactgaactagaactgtcccaacacattcttcctctctcataatggcttccatttaatacaggcaaagccctttaccttagcaaattctttatctttcaaaagtgaccaaaatgaggacttcaaccttggctgcacctcaataggagatgctgatcttgagttgtaatgagaaaagtgggcatataggagattttagtgactgcagtcagctgtctggcattcctttctcagtttgcatctaaaagactacatatgtcaagcttatctccacctgaatttgctgcctgctataaaaacatttcattaatatatcccattcttcctacctccatctctggtttgtcattagtggtattctgaaaagcttaagaaaaaagaatcattgagtagaaagtgaacattttaagttattttcctttttcattggcaattagttaacatgtaaaatcttttccattaaactgtataacttttaataactatatattatatatgggataaaatatatggactgaattgtgagaatataaatgcatcgaaagactctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtcca

SEQ ID NO: 172953 - DNA, 772 bp, Homo sapiens
  Payload ID: 13988
  Gene Symbol: RABGAP1L
  Gene Name: RAB GTPase activating protein 1-like
  Uniprot ID: Q5R372
  ENST ID: ENST00000486220
  CDS Start-End: 272-490
ggaagctctgagtcactgaatagcaaagaaaaatatgaaagcaagaggaattgctttcacatctagaaaatgttgcaagataatctgaaatcttctggtgctggtgaatgcatgaagaggttcacagtatcttttaaagtacttctgaaaagataaggagtttaaaaggtgggtgtgtacactggcactgagctgcagtaggatttttccttggatagtctggtctggagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcaca

SEQ ID NO: 172954 - DNA, 2103 bp, Homo sapiens
  Payload ID: 13988
  Gene Symbol: RABGAP1L
  Gene Name: RAB GTPase activating protein 1-like
  ENST ID: ENST00000469553
  CDS Start-End: 190-483
tatgtagaagaatctggtaaatatggatattaacagcaataagctcctttttaacgatttaattctaccaagtaaatatttgggattactcgctttttgccttttatttaccaaaaaattcatatattttcaaaggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtgggtgtgtacactggcactgagctgcagtaggatttttccttggatagtctggtctggagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtggtaaagggtaagatgatggcatgcaaacactgcagtgacattttcagcaaggagggtgctttgaaactagcagccacaggcagagaggaccagggaattgaaacagatgatgagaaggactcacttaagaagcagctgagagagatggaactggaactggcacaaaccaaactgcagttggtggaggccaagtgtaaaattcaggaacttgaacatcagagaggagcccttatgaatgaaatccaagctgcgaaaaactcttggtttagcaaaaccctgaactctatcaaaacggccacgggcacccagccattgcagccagcaccggtcacccagccacccaaggagagcacatagttccagccttacccaagcacaagagcacaatgttcaaaccaatggaaatctgggaggattcttcctggtgtccctttgaaggaaagtcaaggaggccagaaaacaagccagaatttttcagtagctctcactctttcttgtatgacacttttcaaagggatgctatttaaactgacctgttctatgttgaatacctattttccagcttctggaaggccatgttcagatccatcatagtattacacattattttgtttgcctgatgtttagttggaaataagtaattcagaactaaatgcttttttatttagaattattcataattatttttatcttacat

SEQ ID NO: 172955 - DNA, 648 bp, Homo sapiens
  Payload ID: 13988
  Gene Symbol: RABGAP1L
  Gene Name: RAB GTPase activating protein 1-like
  Uniprot ID: Q5R372
  ENST ID: ENST00000478442
  CDS Start-End: 153-371
accgggagtgtggctggtttctgttgcctgttttgatactcttctcctggtgggtgtgtacactggcactgagctgcagtaggatttttccttggatagtctggtctggagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaccaaccaagaagctgaagaaatatgagaaagaatatcagacaatgcgagagagtcagctgcaacaggaagacccaatggatagatacaagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattga

SEQ ID NO: 172956 - DNA, 710 bp, Homo sapiens
  Payload ID: 13988
  Gene Symbol: RABGAP1L
  Gene Name: RAB GTPase activating protein 1-like
  ENST ID: ENST00000465412
  CDS Start-End: 140-710
ctggtttctgttgcctgttttgatactcttctcctggtgggtgtgtacactggcactgagctgcagtaggatttttccttggatagtctggtctggagctgggacagcagctgctgctgtggaaaggccagctggcaagatgatggaagaaatctccattatggtagcctatgacgcccatgttttcagccagctgcacgatgaagacttcctcactagtctggtggccatcagcaagcccaggtctatggtaccaaccaagaagctgaagaaatatgagaaagaatatcagacaatgcgagagagtcagctgcaacaggaagacccaatggatagatacaagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccagctaaaagaagtcttcaggaaacagctagagaaggcagaatatgaaataaagaagactacagctatcattgctgagtataaacagatctgttcgcagttgagtaccaggctggagaaacagcaagcagccagcaaggaggagctggaagtgg

SEQ ID NO: 172957 - DNA, 722 bp, Homo sapiens
  Payload ID: 13988
  Gene Symbol: RABGAP1L
  Gene Name: RAB GTPase activating protein 1-like
  ENST ID: ENST00000529145
  CDS Start-End: 389-722
tattggggaagggtaaaatggttgaggaaggaggttcgtggaatgtgagagcagaagatgctagtaggagctcattgatatgaactgccaggggatccgtaggtgtctaaagagggaagtgaagccagtaggagactgagagattagaagaacagggcagtagaggatgaatttgcagtgaggttaaaggaacaatttattgggagaagggaatgtaggagggtagaagactttaaaattgaaaagaaataaaaggaggcagggatgtaaaacgagccataagtacaatgacaaatgggcattaaggaggaaaaagactatgtagaagaatctggaacagctaccggacctgcatagccatttttctgatctgaacctggaagctcatatgtatgcatcccagtggtttctcactctttttactgccaagttcccactctgcatggtgttccacatcattgacttactgctttgtgagggtttgaacataatctttcatgtagctttggctctcctaaagacctcaaaggaagaccttctgcaggctgattttgaaggtgctttaaagttctttagagttcagcttccaaagagatacagggcagaggaaaatgcaagaagactgatggagcaggcttgcaatattaaagtaccaaccaagaagctgaagaaatatgagaaagaatatcagacaatgcgagagagtcagctgcaacaggaag

SEQ ID NO: 172958 - DNA, 2103 bp, Homo sapiens; identical to SEQ ID NO: 172954
  Payload ID: 13988
  Gene Symbol: RABGAP1L
  Gene Name: RAB GTPase activating protein 1-like
  ENST ID: ENST00000367686
  CDS Start-End: 190-483

SEQ ID NO: 172959 - DNA, 537 bp, Homo sapiens
  Payload ID: 13988
  Gene Symbol: RABGAP1L
  Gene Name: RAB GTPase activating protein 1-like
  ENST ID: ENST00000485114
  CDS Start-End: 1-264
agtagttggtctatgacttttgaggagagggagaaccgaagattacaggaggccagcatgaggttggaacaagagaatgatgaccttgcccatgaactagtaacaagcaaaattgctctacggaatgacttggatcaggcagaagacaaggcagatgtgttgaataaagagctccttttgaccaaacagaggctggtggagactgaagaggagaagaggaagcaagaggaagagactgcccaggagaatcacatgtgtaactgatgtaggggtttaagtcttcatactttcactaaaatctgtctactaactctcccaccaacctttgcatcaaacacttaggtacctgcctgattaggggggcccctttaagggaaaaaacttttaaaaaattaaatgccttggttttgttttatcttctgggaaagaacacttttacttgattagcaagatgattatattatataacttgcccttaaaaacactccaaaatactgactccttttctccaattacaaatgagtgtgaagaaattct

SEQ ID NO: 172960 - DNA, 1006 bp, Homo sapiens
  Payload ID: 13988
  Gene Symbol: RABGAP1L
  Gene Name: RAB GTPase activating protein 1-like
  ENST ID: ENST00000474375
  CDS Start-End: 1-501
tcagcccaggagagtgttattactcgagatattcatcgtacatttcccgcacatgattactttaaagatactggaggagatggtcaagaatcgctctataagatctgcaaggcctactctgtgtatgatgaagacattgggtactgtcaagggcagtcttttcttgctgctgtattactgctgcatatgccagaggaacaagcattctgtgttttggtgaaaatcatgtacgactatggtttgagagacctctacagaaacaacttcgaagatcttcattgcaaattctaccagttggagagactaatgcaggaacagctaccggacctgcatagccatttttctgatctgaacctggaagctcatatgtatgcatcccagtggtttctcactctttttactgccaagttcccactctgcatggtgttccacatcattgacttactgctttgtgagagtggtatctctgcccttcagttcactgggatggtgactttctaaagtgtctgcccgaatgttggcacccgtggcatcggaacattgtccatgggttttctggaacctagattcaaattttatcttgaagatacatgaatttctaatgtcagttaagaaaactagcaacatttgtgctacagaaaagataaataaatttattagccttcccgtcacttgtcaactgtgacttacaatcagtgtttgaaaggtcataatgttcattaatattaataagaacatcatagatattacctttcctccccttaaacctgtactctatagctgtttaaggaagttggaaaacttttcaaaacatagattgtaatcatagcatcatgatgttcggggaagtaaatggtaacatcctttaccattaaaattgcttttcagaataatctattggaaacaatattgtagtgtgcctcaggatatttattctttccactaactcatctttgtcaagaattattttacaaaggaaatttttgaataaacttttacttcctgc

SEQ ID NO: 172961 - DNA, 3074 bp, Homo sapiens
  Payload ID: 13988
  Gene Symbol: RABGAP1L
  Gene Name: RAB GTPase activating protein 1-like
  ENST ID: ENST00000635248
  CDS Start-End: 111-848
agagcgcgaggtggagggtggaacgcgggcgcctgaaggagttgttgtctcggcagcgcccgcggagacgtgaagaggtggttgtgggaagagaagtttgcagaactgaaatggaggtcagagcttcattacagaaggttagtggatcatctgattctgtggctacaatgaacagtgaagaatttgttttggttcctcagtatgcagatgataattctacaaaacatgaagaaaaacctcaactgaagatagtttctaatggtgatgaacaattggaaaaagccatggaagagattttgagagattccgagaaaaggccaagcagtcttcttgttgattgtcaaagttccagtgagatttcagaccattcgtttggagatattccagccagccaaacaaataagccatctcttcagttaattttggatccgtctaacacagaaatttctacacccagaccatcttctccaggtggactacctgaagaagatagtgttttatttaataaactgacctacttaggatgtatgaaggtttcttccccacgtaatgaagtagaggctttacgggcaatggcaaccatgaaatcttccagtcaatacccctttcctgttaccctgtatgtaccaaatgttccagaaggttctgtgagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcaaggtggggaagcagatggtagaatcctggcatttcatgttggcagccatcatttaacccacctgtgtgatttccgaatcactggagctcaacagcaaggaaatgagctttgaagacctggaaaatctgctgcttggagagagagaaatgctgctgcagaaggatactgaattgctgcaagaagtttccataactaatgagttcgtggatgagagctgaagaggtttgtcgttaaaggaagatttctgaagcaggagtagcagcatggctgccactactgtcactgtgatgcttatttcactataaaatccctcaaactgcaggcatcaacaatggtagaagggaatcccagtgagggtgatggccctcttgaacacctgtgacacaaggattgggaggtcccacagaagggttaggacacatttgacttgcaacacttggatgtgcttctgcaggactgtgctttagtagatttcaataatctatggcaaaagagttggacaatccaaccagaagtatcttgaggtcaatgatctttgtataaggagaatgatatgctaggcttctgctgaagaattgcagaccaagcaaggtatcagaaagtgtagtgaaaaaaatacaaggaggcacctgttcttgtcacatctttttggatatattatataaaactttcaaaagatacttttaaagtgttaattgagtctttctaagattttatttctactagccagtgtaaccattctatgcaaagcagattttgatgatatttgtgtgttttaggatactattcagtattagaaactctgttacattatggaagcatgttttttgtcatctggtgttaaaggcattcagagatacttcttgataaatatcaagggcatcattgggaagatacttattcttattgcattgttttttcttggggttgcagatatgacactgtataaaagaaaacgtgttccttgcatgggaaaatttctttttctttgagatggagtttcactcttgttgtcaaggctggagtgcaatggcgtgatctcggcttactgcaacctacacctcttgggttcaagtgattctccagcctcagcttcccaagtagttgggattacaagcatgcatcaccacacctggataattttgtatttttagtagagacagggttgcaccatgttggtcaggctgctctcaaactcctgacctcaggtgatccacctgcctgggcttcccaaagtgctgggattacaggcgtgagccaccacacccagtggagaatatcatttctaaacaagtatttatttaattgttatgttagctaaatgcctcattttggaagataattcgaagttatcttgttagtgttttccttaaatcaattgatttttatgattttaaaaaagtttcctggtagtgtgcctcttattttagctccttcccatgaataatgtatttgagctagctgttttaaaaattttaatacatacctttcaaggtgcctttcatagaatgatttttcacatttatttcttgggtgaactttttatttttttttttgaggcagagtctcactgtctcccaggctggagtgcagtggcgtgatctcggctcactatgatctccacctcctgggttcaaacgattcttctgcctcagcctcctgagtagctgggattacaggcacatgccaccacgcctggctaatttttgcgtttttaatagagacggggtttcaccatgttggccaggctggtcttgaactcttgacctcaaatgatccacctgcctcagcctcccaaagtgctgggattacaggtgtgagccaccatgcctggccttgggtgaacattttcttgatatatggtgtttccaaaagagtgagttatctttcaccagtattaatgaaaagacttcatcttggagaaactagctatgttatttattttaaataaatacctttgttacttaataacagtgtttggacttttaagatgtaatacatatttgagaatttggaaaatattgaaataaaaaagaaaataaaaggtgcttaaaattccgccgcagttaagattttggtgtatctccattccagatatctacatgtgctctcctccctgcctcttcaaaaacaacagcaacaaactcaaacagatatacagttttgtgtttagtattttctatagatactgttttctggagaaagattgtattatttatcaataaaccttttccttctgcaaagaaa

SEQ ID NO: 172962 - DNA, 1815 bp, Homo sapiens
  Payload ID: 13988
  Gene Symbol: RABGAP1L
  Gene Name: RAB GTPase activating protein 1-like
  ENST ID: ENST00000367690
  CDS Start-End: 97-855
gctggcttttttagtgagagtcaagagctggcttggtaaagtcttaaagaatggagaagaggaggaaggagagaagggaagaaagagggagaatccatgggaaagagctatgatgggagagcttatgtcatcactggcatgtggaaccccaatgcaccagtatttctggcacttaacgaggaaaccccaaaagataagcaagtatacatgactgtggcagtggatatggtagtcacagaggtggtggagcctgttcgctttctcctggagacagtagtccgtgtgtaccctgcaaatgagcgattttggtatttcagcagaaagactttcacagagactttcttcatgagattgaaacagtctgagggaaaaggccataccaatgctggagatgcaatatatgaggtggtgagtctacagcgagagtctgacaaggaggaaccagtcactcctactagtggagggggtccaatgtcaccccaggatgatgaagcagaagaggagagtgataatgaactctcaagtggaacaggtgatgtgtctaaggattgtcctgagaagatcctgtattcttggggagagttgctaggaaaatggcacagtaaccttggtgcacgaccgaaagggctgtctactctggtgaagagtggtgtccctgaagcattgagggcagaggtatggcagttattggcaggctgccatgacaaccaggcaatgctggatagataccgaattcttatcacaaaggtctgttggagtttgctggaggtccactccagaccctgtttgcctgggtatcaccagtggaagctgcagaacagcaaatattgcagaatggcaaatgttgctgcctgatccttcctctggaagcttcatctcagaagggcacctggctgtatgaggtgtcggttggcccctcctgggaggtgtctcccaattagactactcaggtgtcagggacccacttgaggaggcagtctgtccattctcaggtcccaaactacatgctgggagaaccactactctcttcaaagctgtcagacagggacatttaagtctgcagaagtttctgctgccgtttgttcaactatgccctgcccccagtactggagtccaggaaggcaggcaggcctccttgagctttggtgggctccacccagttcagtcttcccggctgctttgtttacctactcaagcttcagcaatggcggatgcccctccctcagccttgctgacacttgcggcttgatctcagactgctgtgttagcagtgagtgaggctccgtgggtgtgggactctccgagccaggtgcgggatataatctcctggtgttccgtttgctaagaccattggaaaagcgcagtattagggtgggagggtcccgattttccaggtactatctgtcatggcttcccttggctaggaaagggaattccccaaccccttgcacttcccaggtgagcaatgccccacgctgctccttgggctgcacccactgtgtgacaagccccagtgagatgaacccggtacctctgttggaaatgcagaaatcacctgtcttctgcgtcgctcacgctgggagctgtagactggagctgttcctttttggccatcttggaacctcggttcaaacctgagttgtaatactcactcttcctgttgctgcctatgtaattttgtagaagttacctaattgcttccaagcttctgttggattttttgagaactgaatgacatagtacattttgaatgcttaatgtattgctttgtgcatggtattatttaataaatattagctttggttatacttgcaa

SEQ ID NO: 172963 - DNA, 3733 bp, Homo sapiens
  Payload ID: 13989
  Gene Symbol: RABGEF1
  Gene Name: RAB guanine nucleotide exchange factor (GEF) 1
  Uniprot ID: Q9UJ41
  ENST ID: ENST00000284957
  CDS Start-End: 78-1553
agacctacccgggcgaagcgggcgagcggtggtttggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttccaaaaa

SEQ ID NO: 172964 - DNA, 3864 bp, Homo sapiens
  Payload ID: 13989
  Gene Symbol: RABGEF1
  Gene Name: RAB guanine nucleotide exchange factor (GEF) 1
  Uniprot ID: Q9UJ41
  ENST ID: ENST00000380828
  CDS Start-End: 172-1689
tttggaattatttgtccaagctaacgtttggacaaataatgttttgttatatttaacattaaaactctgacattgacattcacattcattttggaagcattatatttaatcatatgaaagttggtgaaccttggattacagattgcaaatgctaataagtcttttattagaatgatggcgtcttcataccatgaagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttcc

SEQ ID NO: 172965 - DNA, 4319 bp, Homo sapiens
  Payload ID: 13989
  Gene Symbol: RABGEF1
  Gene Name: RAB guanine nucleotide exchange factor (GEF) 1
  ENST ID: ENST00000437078
  CDS Start-End: 1245-2144
gttatgttttttttgagacaggatctcgctctgctgtcacccggcctggagttcagtggagggatctctgcaccgtcaacttcctgggctatcaagcgatcctcccacctcagcctccctggtagttgggaccacaggtgcccgccatcatgtccggctgatttgtaaaatttcttttgtagagatggtgaccttgctctgtggcccaggctggtctcgaactcctggactcaagcgatcctcctgcctgggcctcctaaagattcagctgcttttggatcaaccgatcgccttaagaccttttaactcgaacacctgtcacatcctaggatccgcgaaggactgaaacagagtttctgaagcgtccctcggcgcagtagctccgctccacctcccattcgcgctaccaccgcggccgcagccccaggagtcgccgcggagccagcgtcgccctccagctgttgcgcgtcggaagccggaagcagggactgagcgacagactaggaaacgccggtttctccggggctccccagcgccccacctttaccccggaggccgccctcttccatttgctcttgggcgtcagggcggtaccccactccgctcgaccctttggatccactcgcacttcctcccgtccagagtcaaaggccccggaagtgacgtttacgcgccgcgcgtaacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttcc

SEQ ID NO: 172966 - DNA, 3065 bp, Homo sapiens
  Payload ID: 13989
  Gene Symbol: RABGEF1
  Gene Name: RAB guanine nucleotide exchange factor (GEF) 1
  ENST ID: ENST00000439720
  CDS Start-End: 168-1682
ttatttgtccaagctaacgtttggacaaataatgttttgttatatttaacattaaaactctgacattgacattcacattcattttggaagcattatatttaatcatatgaaagttggtgaaccttggattacagattgcaaatgctaataagtcttttattagaatgatggcgtcttcataccatgaagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttcca

SEQ ID NO: 172967 - DNA, 553 bp, Homo sapiens
  Payload ID: 13989
  Gene Symbol: RABGEF1
  Gene Name: RAB guanine nucleotide exchange factor (GEF) 1
  ENST ID: ENST00000442563
  CDS Start-End: 418-553
agacctacccgggcgaagcgggcgagcggtggtttggacgccggcggagacgcgggcgagaaaactgtggatttagttactccactctgccatgtctttccaccactgcctgcacatttgagaccaaggatagagattgggaaaaattgatagttctcctgcctcagagtttggctcctgcactctcatttcagccatagctgcagacaaagcacacgattgctgggcactgtggctcaagagaaggaggagatgtttgtttatatggagaagaatgaagaccatgtggtttcagtttgaacggaaattgttgcatagcgatttaccatacagctgtgagactgaacaaatgagtttaaatattatacagtagaaaagaaaactgactttggaacttaagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaag

SEQ ID NO: 172968 - DNA, 2281 bp, Homo sapiens
  Payload ID: 13989
  Gene Symbol: RABGEF1
  Gene Name: RAB guanine nucleotide exchange factor (GEF) 1
  Uniprot ID: Q9UJ41
  ENST ID: ENST00000450873
  CDS Start-End: 273-1748
agacctacccgggcgaagcgggcgagcggtggtttggacgccggcggagacgcgggcgagaaaactgtggatttagttactccactctgccatgtctttccaccactgcctgcacatttgagaccaaggatagagattgggaaaaattgatagttctcctgcctcagagtttggctcctgcactctcatttcagccatagctgcagacaaagcacacgattgctgggcactgtggctcaagagaaggaggagatgtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgttt

SEQ ID NO: 172969 - DNA, 3553 bp, Homo sapiens
  Payload ID: 13989
  Gene Symbol: RABGEF1
  Gene Name: RAB guanine nucleotide exchange factor (GEF) 1
  ENST ID: ENST00000510829
  CDS Start-End: 155-1378
aacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaagcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttcc

SEQ ID NO: 172970 - DNA, 2654 bp, Homo sapiens
  Payload ID: 13989
  Gene Symbol: RABGEF1
  Gene Name: RAB guanine nucleotide exchange factor (GEF) 1
  ENST ID: ENST00000607882
  CDS Start-End: 968-1327
ccagacctgccgagcgacgtgggcgagcggtgacctggaccacggcgcagacgcgggcgagctgcggctcggacgccagcggacacgcgggcgagatcactttgggaagcagtgacatccaacctgtatcaagtcttctaatctgtgaacatggatctcgctctgctgtcacccggcctggagttcagtggagggatctctgcaccgtcaacttcctgggctatcaagcgatcctcccacctcagcctccctggtagttgggaccacaggtgcccgccatcatgtccggctgatttgtaaaatttcttttgtagagatggtgaccttgctctgtggcccaggctggtctcgaactcctggactcaagcgatcctcctgcctgggcctcctaaagattcagctgcttttggatcaaccgatcgccttaagaccttttaactcgaacacctgtcacatcctaggatccgcgaaggactgaaacagagtttctgaagcgtccctcggcgcagtagctccgctccacctcccattcgcgctaccaccgcggccgcagccccaggagtcgccgcggagccagcgtcgccctccagctgttgcgcgtcggaagccggaagcagggactgagcgacagactaggaaacgccggtttctccggggctccccagcgccccacctttaccccggaggccgccctcttccatttgctcttgggcgtcagggcggtaccccactccgctcgaccctttggatccactcgcacttcctcccgtccagagtcaaaggccccggaagtgacgtttacgcgccgcgcgtaacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttc

SEQ ID NO: 172971 - DNA, 2430 bp, Homo sapiens
  Payload ID: 13990
  Gene Symbol: RABIF
  Gene Name: RAB interacting factor
  Uniprot ID: P47224
  ENST ID: ENST00000367262
  CDS Start-End: 38-409
cgcagccgtggctgaggagcctgtggcggcagcggcgatggaaccagcggagcagccgagcgagttagtgtcagccgagggccgaaaccggaaggcggtgctgtgccagcgttgcggctcccgggtgctgcagccagggaccgctctcttctctcgccgacagcttttccttccctccatgagaaagaagccagctctgtctgacggcagcaatcctgacggcgatctcctccaggaacactggctggttgaggacatgttcatttttgagaatgtgggcttcaccaaggacgtgggcaacatcaagtttctggtctgcgcagactgtgaaattggaccaattggctggcattgcctagatgacaagaacagtttctatgtggccttggaacgagtttcccatgagtaactgaggggaggggtactcagctccatctccaaagataaacctactccccacaagaactggcctttaatgtggtataactgttccgctgccttcttgtctgtgctaatataaatactgagtaccagcatgtccatttgaacatgcagagggttaatcctgcttcctaaagcctcaagtacatgcctcctgcttagttcactttgtatcacatttcctaagctcccttttcccccagttttgggacactgtgcttacctccaaaaatctcatctcttccctggcattctccctaggctctgttttgcccaggggctcccgctttttcttgctctagaagagcagtattcaaccttttagctatgatgacacataacaaaagatgcttatgtactaatagttgaaatctgcctttttctcattcaagaaggcatacaaatatctgagagtgactttgttgtatggctacccttgtgatctacagtaatttattctttctaaaggtaaagcattttcaaaactcagtatttaaaccactaaccagaaacattactttggatgcatctctaataccatgtttgagcacctctgctctaggttgagaatgacattttattgtgaagatgggtgtggtccctcttcccttgaaatcttgtagtttctttttatattagctcctcactgctacagcctagaaggtgagaagcagattttaaccccatctggcagccattcaaggaaaacccagccctggctgtttactcaggctctcttagaatgagagtggagggtgtaggatatgagggttaggcctttgccacattatacaaaagtttataatttgccacatctggacaagtaactttcttcttttgttcataggcaagacttctttaatggatagtatcatttactgaacctactgggcatggtcctcatggagttttggttcaactggaatctctgtgccaacccaggatacaaacttccatccagatgcatggatacaaatttccatagctccggggctgctctaacagtttgatatcagcagacgtgtttaagccttcaacttgatttccaattattccatcatttctattctgaaatgactcactgtcgtagaaggaagtttattatataaccaaggtttcaggtatcctcctgtcaccacctctactattcaggaggcctaaaattgaaataagtactaaacagaaaccttaccatctgaagtcccttccattgttttctagttgcttcctcattcctttacccccaaactttctaagggctccccgactgcagtgcaaggtggccttgggcacagttttgcaaccaacctactcccctggaaagatggcttccttctccaattagcctgaatgagctttagtaagcaattgagagaactgtgtttttccgacaaacggtcacatgtccatcgttatggcatgtgcagaaaaacagagttatccacacaagtcaggagcaaaacccaagtagatgcctctaggggcacatggcccctcacatcacaagccagaacctaagctaagcattttttaaattgagtttgagactagcctgggcaacatagtgagaccccatctctatttaaaaaatgaacaaaattacctgggcatagtggtgtatacctgtagtccctgctacttgggaggctcaggtgggaggatcacttgagccccaaagatggtggctgcagtaagccaagatcacaccactggcactccagcctgggcaacagagtgagaccctgtctcaaacaaacaacaacagtaacaacaaaaaaatatatagcgacttgaataggaaaccatagtatttcattgttttaatttgcatttattttatttctagtgaaacttttatatacgtatcggtcatttctatttccttttttgagaactgccaaatgttgccctagtagccaaaaatatcaggttgctattctgccttttcagtttgatctgaaagaaataaaggcatttaagcaatggaaa

SEQ ID NO: 172972 - DNA, 1771 bp, Homo sapiens
  Payload ID: 13991
  Gene Symbol: RILP
  Gene Name: Rab interacting lysosomal protein
  Uniprot ID: Q96NA2
  ENST ID: ENST00000301336
  CDS Start-End: 274-1479
acttgcagccctgaacctcagctcttggacgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagccggggccctgggcactgagctgcaggatctggcgcgccgtttcgggccggaggcggcggccgggctggtgccgctagtggtgcgggcgctggagctcttggaacaggctgccgtggggcccgccccggactcgctgcaggtgtcggcgcagccggcggagcaggagctgcggcggctgcgggaggagaacgagcgcctccgcagggagctgcgcgcggggccacaggaggagcgcgcgctgctgcggcagctcaaggaggtcacggaccgacagcgggacgaactccgggcgcacaaccgcgacctgcggcagcgcggccaggagaccgaggcgttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcgggagctgctcacagaccaccgggtccccggccttctgctcgaggccatgaaggtggctgtccggaagcagcggaagaagatcaaggccaagatgttagggacaccagaggaagcagagagcagtgaggatgaggctggcccatggatcctgctctccgatgacaagggagaccatcccccacccccggagtccaaaatacagagtttctttggcctatggtatcggggtaaagctgaatcctctgaggatgagaccagcagccctgcacccagcaagctagggggagaagaggaggcccaaccacagtctccagctcctgatccgccctgttctgccctccacgaacacctttgtctgggggcctcagccgccccagaggcctgacttaggggtctggctgtggaaggatgtgtggcctcaaatgaggacagggctcccgccttcacagccctcgccaggggtctgccccaatcctggcctgcatcagggcaggacggggtctcagcccgcctccctctctacgtctctgtaccgagcctctggggccagatataagagtgcctctctgagtctcagtttccccatccatgaaatgagagctgactgcctagctcccagggctttgtgcagacggcctgagctcatgtaataaagaactgcccgtaatacacagaaa

SEQ ID NO: 172973 - DNA, 978 bp, Homo sapiens
  Payload ID: 13991
  Gene Symbol: RILP
  Gene Name: Rab interacting lysosomal protein
  ENST ID: ENST00000574810
  CDS Start-End: 1-681
ctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcgggagctgctcacagaccaccgggtccccggccttctgctcgaggccatgaaggtggctgtccggaagcagcggaagaagatcaaggccaagatgttagggacaccagaggaagcagagagcagctttggcctatggtatcggggtaaagctgaatcctctgaggatgagaccagcagccctgcacccagcaagctagggggagaagaggaggcccaaccacagtctccagctcctgatccgccctgttctgccctccacgaacacctttgtctgggggcctcagccgccccagaggcctgacttaggggtctggctgtggaaggatgtgtggcctcaaatgaggacagggctcccgccttcacagccctcgccaggggtctgccccaatcctggcctgcatcagggcaggacggggtctcagcccgcctccctctctacgtctctgtaccgagcctctggggccagatataagagtgcctctctgagtctcagtttccccatccatgaaatgagagctgactgcctagctcccagggctttgtgcagacggcctgagctcatgtaataaagaactgcccgtaatacacagaaactgtt

SEQ ID NO: 172974 - DNA, 1771 bp, Homo sapiens; identical to SEQ ID NO: 172972
  Payload ID: 13991
  Gene Symbol: RILP
  Gene Name: Rab interacting lysosomal protein
  Uniprot ID: Q96NA2
  ENST ID: ENST00000622136
  CDS Start-End: 274-1479

SEQ ID NO: 172975 - DNA, 978 bp, Homo sapiens; identical to SEQ ID NO: 172973
  Payload ID: 13991
  Gene Symbol: RILP
  Gene Name: Rab interacting lysosomal protein
  ENST ID: ENST00000633176
  CDS Start-End: 1-681

SEQ ID NO: 172976 - DNA, 2389 bp, Homo sapiens
  Payload ID: 13992
  Gene Symbol: RILPL1
  Gene Name: Rab interacting lysosomal protein-like 1
  ENST ID: ENST00000340724
  CDS Start-End: 1068-1919
aaaatcatgacagtgttgtacaaccatcacctgttttgttccaaaacactttcaccaccttcctgaggtgactgcacctggcaggtctctccccagcctcttgtctctgccctccctccctgcaggtacaaccactggcagcctctaatctgctttctgcctctgtggatttgccagttctggatatttcctatcgatgaaatcacactgtatgcaaccttggggtctgatcttagaccccacgtcatttttgaggttcatccgtgctgtggcgtgtcagagctgctttcctcgttatggctgaattgtcctccactgtgtggactgagcgcgttgtgcttatccattcttagcggggggacatttgggtggcttccatctttcatctgctacagatagtgctgctgtgaactttgtcacttaacagtctatctcagtgttttcgacggcacatcgtgtctcatggtgtcccactgcctggacagtgccttgctggtggacagtagctcactgccagattctcactcccacacgtgtggctgctgtggctggccacggacgagcttctccatggtgcccctgcccaagtgtctcttaaaatctaggtccctagatcctgaattgctgggtgtgtatgatggctcacaactcttccagcttttaacagtgtctgttaagaatacttggccttctcttagttttccaaagcactcttgtactttctcttagcagtgacctgtgaagcggggaggcctggtctttccgtatcaggataaaatgacttagacactctggccctgggcccctctgttgtgagcacttcacatcgatgaagcgtgcacaggcctctcgagagcaccgaggcctgaagggaaagcaactaagaggccgaagctgggataggagtcaggcgccaggcttctgcctcggtctcatagctcctacggctgccgcccaggaaggtgatgaggctgctgggcttccacatagacccagccgcccctctctcctcatgctcgcctcccgcccacctctcggggagccaaggcagccccagcaaggagtaaatgagcatgtcagagcgggagcgacaggtgatgaagaagctgaaggaggtggtggacaaacaacgcgacgagatccgcgccaaggacagggagctgggcctgaaaaatgaggacgttgaggctttacagcagcagcagacacggctgatgaagatcaaccatgaccttcggcaccgggtcacggtggtggaggcccaggggaaagccctgatcgaacagaaggtggagctggaggcagacctgcagaccaaggagcaggagatgggcagcctgcgagcagagctggggaagttgcgagagaggctgcagggggagcacagccagaatggggaggaggagcctgagacggagccggtgggagaggagagcatctccgacgcagagaaggtggccatggatctcaaggaccccaaccgcccccggttcaccctgcaggagctgcgggacgtgctgcacgagaggaacgagctcaagtccaaggtgttcttgctgcaggaggagctggcttactataagaggtttccacatgagaccacaagcaacatgagaccagaagtcttatttatcttgtccatggctaagttcccagcacttagaatggagcttggcacacatgaagaaatggaagaggaaaaccgaataccccaacccccacccatcgcccacccgaggacgtccccccagccggagtcgggcatcaagcgactgtttagcttcttctcccgagataagaagcgcctggccaacacacagagaaacgtgcacatccaggagtcctttggacagtgggcaaacacccaccgcgatgacggttacacagagcaaggacaggaagccctgcagcatctgtgaccttggcccatctccaccctccaacctggactgcccgccaccagcgcctgcaaccgaactgcagcccaggggtcattgctgcctcaagcctctcggtgcagatgcaccctgaaaactgacccctcaaacagactgtctgatttgaggatggacattgaaaaactgacgccaaactctaaagaaatgtttatttatacccagggctatcactgtttctaatagatgactctgatcccgtaggatatatatttaataatcccacaaacggaggccagacttctgcgttaacttcagtaacacaagcttctttaagccaaatacatcacttgccactatcattgctgtttgacttgctttgtataaaatgctatgtgtagaggttttattatcacaggtgacatagttcagcaggaggcatggaagggctagatcttcattagttacattcatgaaattgtgatggtaacgta

SEQ ID NO: 172977 - DNA, 3932 bp, Homo sapiens
  Payload ID: 13992
  Gene Symbol: RILPL1
  Gene Name: Rab interacting lysosomal protein-like 1
  Uniprot ID: Q5EBL4
  ENST ID: ENST00000376874
  CDS Start-End: 237-1448
ctcgggagcagctccgggccgagccgggcgcccagaccccgggcccgcacaccccgcgccgccgcccgtgcccgcgcccgcgcccgccgcccgctgcccgctgcgccctcgccccagcgcccgctgagcgcgcccgcccgcggcccaggctgggcccggccggcccggccctcgacagcggcaagtttgggagttgcacgagtttgcggggcgggggacaggccaggagggtggccatggaggaggagcgggggtcggcgctggcggccgagtcggcgctggagaagaacgtggccgagctgaccgtcatggacgtgtacgacatcgcgtcgcttgtgggccacgagttcgagcgggtcattgaccagcacggctgcgaggccatcgcgcgcctcatgcccaaggtcgtgcgcgtcctggagatcctggaggtgctggtcagccgccaccacgtcgcgcccgagctggacgagctgcgcctggagctggaccgcctgcgcctggagaggatggaccgcatcgagaaggagcgcaagcaccagaaggagctggagctggtggaggatgtgtggcgaggggaggcgcaggacctcctctcccagatcgcccagctgcaggaggagaacaagcagctcatgaccaacctctcccacaaggatgtcaatttctcagaggaggagttccagaagcatgaaggcatgtcagagcgggagcgacaggtgatgaagaagctgaaggaggtggtggacaaacaacgcgacgagatccgcgccaaggacagggagctgggcctgaaaaatgaggacgttgaggctttacagcagcagcagacacggctgatgaagatcaaccatgaccttcggcaccgggtcacggtggtggaggcccaggggaaagccctgatcgaacagaaggtggagctggaggcagacctgcagaccaaggagcaggagatgggcagcctgcgagcagagctggggaagttgcgagagaggctgcagggggagcacagccagaatggggaggaggagcctgagacggagccggtgggagaggagagcatctccgacgcagagaaggtggccatggatctcaaggaccccaaccgcccccggttcaccctgcaggagctgcgggacgtgctgcacgagaggaacgagctcaagtccaaggtgttcttgctgcaggaggagctggcttactataagagtgaagaaatggaagaggaaaaccgaataccccaacccccacccatcgcccacccgaggacgtccccccagccggagtcgggcatcaagcgactgtttagcttcttctcccgagataagaagcgcctggccaacacacagagaaacgtgcacatccaggagtcctttggacagtgggcaaacacccaccgcgatgacggttacacagagcaaggacaggaagccctgcagcatctgtgaccttggcccatctccaccctccaacctggactgcccgccaccagcgcctgcaaccgaactgcagcccaggggtcattgctgcctcaagcctctcggtgcagatgcaccctgaaaactgacccctcaaacagactgtctgatttgaggatggacattgaaaaactgacgccaaactctaaagaaatgtttatttatacccagggctatcactgtttctaatagatgactctgatcccgtaggatatatatttaataatcccacaaacggaggccagacttctgcgttaacttcagtaacacaagcttctttaagccaaatacatcacttgccactatcattgctgtttgacttgctttgtataaaatgctatgtgtagaggttttattatcacaggtgacatagttcagcaggaggcatggaagggctagatcttcattagttacattcatgaaattgtgatggtaacgtattatacagaatgtatccatcaggcagacaaggggtctgaagtcacaggctcagtagcccaactcagacacaaagccacagacaatatggatgatggtcctcttacccagaaactggagacaactttgcaggcaccctggctgcgttcctgataatgcctagagcatgtagcaatgttcaaggcaggtgccttggaatctgctgtgagttatgcagtactaaccaaacaaagttgctaaggatgagatgttgcaacatttcttgtgtgcacttttttttcctgacatctttttttccttttaggattcattaagtcatatacttagtcccctgcaaagaagaagacagatgtcccagagcagactgaaagcggggcgtgggatcctaggcaatgcaggagggcaggtgggggagctgtagcagaacaagggtgctaggtgggaagctggcttggggaccacacgtctggctgactcacagggctatagcagcagacagagagccagatgctctactgcaactggtgagttggaggcttgcccacataacactgtctttctctccacccgccaagcatccagggcacagggctggttgctcacagattgagcgaggtagcacctcctaccagcactcaagtttatcagggccgcgttctaaacattctactgaagtttgctaagaaaccattaggtgaggctgggcacagtggctcacgcctgctatcccagcactttgggaggccgaggcaggtgggtcacttgaggtccggagttcgagaccagcttggccaacacggtgaaaccccatctctacaaaaatacaaaaaaattagccaggcgaggtggtgcatgcctataatcccagctgctcaggaggccgagacaggagaattccttgaacctaggaggcagaggttgcagtgagcctagatcgtgccattgcactccagcctgggcgacagagtgagacttcatctaaaaaaaaaaaaaaaaagaaagaaagaaaccatcaggtgaatttgcagaatctagaatggactctgcttccagattgccgaaaaaaagaaatgatcagacagggtaattattgctgcgttagagcagtgtttctcaaacctgagtgcccattagaattattagaatttattctcaaagagtatagaagcaggtatactgatgaatttctctcccacccctggccacctttgttgcccttccaacaggtaaccaaaattgccagtttcttggttatctttcctaaacactaaatgtctctcttttttttgagatagtcttgctctattgcccaagccaaagtatagtggcaccatctctgctcactgcaacttccgcctcttgagttcaagcaattctcatgcctgagcctcccaagtagctgggactacatgtgtgtgccaccatacctgactaatttttgtatttttagtaaagacggggtttcaccatgttggccaggctggtctcgaggtctcgaactcctgacctcaagtgattcacctgccttggcctctcaaagtgctgggattacaggtgtgagccactgtggctggccttttttttttttttttttttggacacagggtctcactctgtcacctaggctggagtacagtggcactatcatagctcattgcagctatgaacccctgggctcaagcaatcctcccacctcagcctcccaagtagctggtactactgatgtgcaccaccatgcccagctaattattttttgtagagaccaggtcttactttgttgcctaagctggtctcaaactcctgggctcaagtgatcctcacaccccagcctcccaaagtgctgggaattcaggtgtgagccaccgtgcctggccaaatgtcacttttttgataagtcagcagatccagctcttgagcacatcagaggctagataatcgggacagaaaggaaaaatcaatccatcagaaagtttatacatgcaattatgtaaaataaaatcaagaacaaaaagcata

SEQ ID NO: 172978 - DNA, 769 bp, Homo sapiens
  Payload ID: 13992
  Gene Symbol: RILPL1
  Gene Name: Rab interacting lysosomal protein-like 1
  ENST ID: ENST00000544468
  CDS Start-End: 168-398
gttcaaagatgggagaggccgggcgcggtggctcatgcctgtcatcccagcactttgcgaggccgaggcaggcggatcacttgaacccaggactcgaaaccagcctgggcaacatagtgggacccccatctctacacaaaaatttttaaaaattagccagtgaagaaatggaagaggaaaaccgaataccccaacccccacccatcgcccacccgaggacgtccccccagccggagtcgggcatcaagcgactgtttagcttcttctcccgagataagaagcgcctggccaacacacagagaaacgtgcacatccaggagtcctttggacagtgggcaaacacccaccgcgatgacggttacacagagcaaggacaggaagccctgcagcatctgtgaccttggcccatctccaccctccaacctggactgcccgccaccagcgcctgcaaccgaactgcagcccaggggtcattgctgcctcaagcctctcggtgcagatgcaccctgaaaactgacccctcaaacagactgtctgatttgaggatggacattgaaaaactgacgccaaactctaaagaaatgtttatttatacccagggctatcactgtttctaatagatgactctgatcccgtaggatatatatttaataatcccacaaacggaggccagacttctgcgttaacttcagtaacacaagcttctttaagccaaatacatcacttgccactatcattgctgtttgacttgctttgtataaaatgctat

SEQ ID NO: 172979 - DNA, 6141 bp, Homo sapiens
  Payload ID: 13993
  Gene Symbol: RILPL2
  Gene Name: Rab interacting lysosomal protein-like 2
  Uniprot ID: Q969X0
  ENST ID: ENST00000280571
  CDS Start-End: 298-933
ctgaacttccccgttcctcttctcggctgcctccttttccgttgtcccttcgcgccccaaaccacatcctggagcgcactctccagcgtggctggcagcggggacggtgcgccggggcgcaggcccaagagtcgcgtgcgcggccccttgcaccatccccccgggcccacccccgggccgcgctgattgggcaggtagggactctgcccagcggaaagttttgggtgccgggaggaagtctaacctttgggagactccaagacagcagctccgaggtcggcgggggtctgggtggccatggaggagccccctgtgcgagaagaggaagaggaggagggagaggaggacgaggagagggacgaggttgggcccgagggggcgctgggcaagagccccttccagctgaccgccgaggacgtgtatgacatctcctacctgttgggccgcgagcttatggccctgggcagcgacccccgggtgacgcagctgcagttcaaagtcgtccgcgtcctggagatgctggaggcgctggtgaatgagggcagcctggcgctggaggagctgaagatggagagggaccacctcaggaaggaggtggaggggctgcggagacagagccctccggccagcggggaggtgaacctgggcccaaacaaaatggtggttgacctgacagatcccaaccgaccccgcttcactctgcaggagctaagggatgtgctgcaggaacgcaacaaactcaagtcgcagctcctggtggtgcaggaagagctgcagtgctacaagagtggcctgattccaccaagagaaggcccaggaggaagaagagaaaaagatgctgtggttactagtgccaaaaatgctggcaggaacaaggaggagaagacaatcataaaaaagctgttcttttttcgatcggggaaacagacctagatccaaggccacaagtaaggctatggctctgattctagaagacaaccttccaagatgcctggcaaaaccacctccctgtgccacacagacacactaggcctgtgtatttatttccccttcaaagcagactgaggagggaggagacgaggttctcttggcatcactttctccctggctgcagaactagacacccttgaagatttggcctgggccagtgagactgaaatcaagaaaaacagaagggatgtgcagggtgggggggtccacttcctgctcccatgtcaacccccagggcctccagcgtgcagacgcgtgtcctactcatctgctcccacggatgaccctggtcttcaatggttagcagaagggagaaaagaaagcaggaaaatgtgctattgagattccagtggtgacttcactgatatttagtgaatatttgatttagccaacatgcctttctttatgtgattttgtattaaagtaaaatgatttttatactttctatagcttatctagagtggtctcttagttacgatggtacacatggtatatgtgtgtatatgtcatatatctacatttcattgtataatgaatcaattgcattcattcagtctaagcgatgcacgattatctggtgtcactatgaagggaaagattgctgcaaactaaaatgttaagaagctatcgattttaggactcatcctgatttcagaggtgttaagatgtgaacaaaatgcatttaggaatcaatgaaacagagagcgggtgtctgcacttcgcaaaggaactaatgaggctgccgcaaccattccgtgagcctgtcttcttagtaaataacagtggcttactcaatgtgtttcgcctgctctgtggattatctcatttgttcctcataacctggggagatggggaccggtaccggtgcaccagtttatagattttttttttttttttttttgagacggagtctctcgctctgtcgcacagtctggagtgcagtggcacgatctcggctcactacaagctctgctgcctacgttcacgccattctcttgcctcagcctcctgagtagctgggactacaggcacttgccaccacactcgtctaatttttttgtatttttagtagagacagggtttcgccgtgttagccaggatggtctcgatctcctgacctcgtgatccacccgcctcagcctcccaaagtgctggtgagaggtgacagcgtgctggcagtcctcacagccctcgctcgctctcggcgcctcctctgcctgggctcccactttggcggcacttgaggagcccttcagcccaccgctgcactgtgggagcccctttctgggctggccaaggccggagcccgctccctcagcttgcagggaggtgtggagggagaggcgcgagcgggaaccggggctgcgcggggcgcttgcgggccagctggagttccgggtgggcgtgggcttggtgggccccgcactcggagcagctggcgggccctgccggctccgggcaatgaggggcttagcacccgggccagcggctgctgagggtgtgctgggtcccccagcagtgccagcccaccggcgctgcgctcgatttctcgccgggccttagctgccttcccgtggggcagggctcgggacctgcagcccgccatgcctgagcctcccaccccctccgtgggctcctgtgcggcccaagcctcctccacgagccccaccccctgctccatggtgtccagtcccatcaacgacccaagggttgaggagtgcaggcacagggcacgggactggcaggcagctccatctgcagccccggtgcgggatccactgggtgaagccagctgggctcctgagtctgctggggacgtggagaacctttgtgtctagctcagggattgtaaatacaccaatcggcactctgtatctagctcaaggtttgtgaacacaccaatcagcaccctgtgtctagctcagggtttgtgaatgcaccaatcgacattctgtatctagctactctggtggggccttggagaacctttgtgtccacactctgtatctagctaatctggtggggacgtggagaacctttgtgtctagatcagggattgtaaacgcaccaatcagcgccctgtcaaaacagaccacttggctctaccaatcagcaggatgtgggtggggccagataagagaataaaagcaggctgccccaggcagcagtggcaacccgctcgggttcctttccgcattgtggaagctttgttcttttgttctttgcaataaatcttactactgcttactctttgggtccacactgcttttatgagctgtaatactcaccccgaaggtctgcagcttcactcctgaagctagggagaccaggagcccaccaggaggaacgagcaactccagacgcgccgccttaagagctgtaacactcaccacgaaggtctgcagcttcactcctgagccagcgagatcacgaacccaccagaaggaagaaactccgaacacatctgaacatcagaaggaacaaactctggacacgccacctttaagaactgtaacactcaccgcgagggtccgcggcttcattcttgaagtcagtgagaccaagaacccaccaattccggacacactgggattacaggcgtgagccaccgcacccggcttttttttggggggtggtggggacggagtcttgctctatcgcccaggctggagtgcagtggcaccatctgggttcactgcaatctctgcctcccagattcaagcgatgctcctgcctcagcctcccgactagctgggactataggtatatgccaccacactgggttaatttttgtatttttgtagagacggggtttcaccatattggccaggctggtctcgaactcctgacctcatgatccgccctcctcggcctcccaaagtgctgggattacaggcgtgagtcaccgtgcccggccagtttataggtttagaaactgaaactctggctgtggagctaggaagcagcttgcccaggaggcaaatgcaggcctgattccaaggcccgggcgcggagctgccaagctttatgggtccagagtcactggcaagtcctaataatagtaataatttactgtatgcctcgcctgcatcattctaagtacctttccgatgctgtctcacatacttttgtgggatgggtatcactattgtccttggggtcctcccaaggaggttaaggcataatgggtgaaaagtcttgtctaaggtcctcagctagaaagtggtagaagcaggacttgagcccagatacaaagtccacacacaggcttcaaccactctgccttccaggaagagctggtagtgtttaagagtctagtccagaacactgtctcaacagcatcattagatcagggctcctaatccctagaaccctgtgtaacactgcaaccctggccaggcatagtggttcaagcctgtaattccagcacttttggaggccaaggtgagaggattgcttgagcccaggagttcgagaccagcctaggcaacatagtaagaacctatctttacaaaaaacaaaaaattagccaggcatggtggtgagcacctgtagtcccagctcctggggaggctgaggcgggaagattaattgagcccgggagtttgaggctgcagtgagctatgatcacaccactacactccagcctgggtgacagagtgagaccctgtctccaaatatataaatgctcccctgcctccctgtggggatagatagggtaagagaacccactcagaaagaaaggttaagatggcctgggtggctgtggtaccccaggagactaaaaaaagttacggtgagaaatgcttggactgcaactcttggtaaaatctgatgctggcaggtgggcattttggaaaataagtccttggggtgattctcctagagatgggcctagcttgacaacaggtaacagagctgtgacgtcagctgagctctggcggttctcacactgcaggattccaactacaaacctagaccggggaggaacaggctcagaagtaggttttcgccgggtgcagtggctcatgcttgtaatcctagcactttgggaggccgaggtgggtggatcacaaggtcaggagttcgagaccagcctggccaagaaggtgaaaccctgtctctactaaaaatacaaaaattagctattcaggaggccaaggcaggggaattgcttgaacctggatggcagaggttgcagtgagctgagttcatgccactgcactccagcctgggcgacagaatgagactccgtctcaaaaaaaaaaaaaaaaaaaaaaaggttttcaagccaagtctcagaaggcacaggaggtggttgctgtagcaatcatcttttattttatttatttgagacagagtctcgctctgtcgcccaggccggagtgcagtggcaggatctcagctcctgacctcataatccgcctgcctcgccctcccaaagtggtgggattacagggattaccgtgcctggccagcagtcatcttttacaatgaacaaatagggctgggcgcggtggctcacatctgtaatcctagcactttgggagatgggcagatcacgaggtcaggagaccagcctggccaacatggtgaaacctcgtctctactaaaaatacaaaaattagctgggtgtggtgatgcacgcctgtaatcctagctactcaggaggttgaggcaggagaatcgcttgaacccgggaggtggaggtttcagtgagctgagattgcaccactgcactccagcctgggcgacagacagaccaagactccatctcaaaaaaaaaataaataaataaataaaaataagtcaggcacagtggctcacgcatgcctgtaatcacagccctgtgggagggtgaggcatgaggatcgcttgaggccaggggtttgagactagcttgggcaacatagtgagaccctatctctacaaaaagtaaaatgaacaaataaatatagcaactacatatcagaacttggaggcacttattagctattagtcctgagtacttgtaaacactgaatagaagctagccaaatttttaattctaataatagctaatactgattactgaaggctatgtgcaaggcactgttccaagtgttgttttttttttttttgtattaactcattaaatcctcacaatcaccc

SEQ ID NO: 172980 - DNA, 623 bp, Homo sapiens
  Payload ID: 13994
  Gene Symbol: RABL2A
  Gene Name: RAB, member of RAS oncogene family-like 2A
  ENST ID: ENST00000376439
  CDS Start-End: 68-565
actcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggaatagtttggaccttgtgcctcctgtgggaggctgaggact

SEQ ID NO: 172981 - DNA, 1118 bp, Homo sapiens
  Payload ID: 13994
  Gene Symbol: RABL2A
  Gene Name: RAB, member of RAS oncogene family-like 2A
  Uniprot ID: Q9UBK7
  ENST ID: ENST00000393165
  CDS Start-End: 211-900
ctgcgaggacgcggggcgagccggaagtggagtgcgctgcggtgcgagctgggccggcggggtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggacttttgggacacggcaggccaggagcggttccagagcatgcatgcctcctactaccacaaggcccatgcctgcatcatggtgtttgatatacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataa

SEQ ID NO: 172982 - DNA, 1052 bp, Homo sapiens
  Payload ID: 13994
  Gene Symbol: RABL2A
  Gene Name: RAB, member of RAS oncogene family-like 2A
  Uniprot ID: Q9UBK7
  ENST ID: ENST00000393166
  CDS Start-End: 148-834
ggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggacttttgggacacggcaggccaggagcggttccagagcatgcatgcctcctactaccacaaggcccatgcctgcatcatggtgtttgatatacagaggaaagtcacctataggaacctgagcacctggtatacagagcttcgggagttcaggccagagatcccatgcatcgtggtggccaataaaattgatgacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataa

SEQ ID NO: 172983 - DNA, 2179 bp, Homo sapiens
  Payload ID: 13994
  Gene Symbol: RABL2A
  Gene Name: RAB, member of RAS oncogene family-like 2A
  Uniprot ID: Q9UBK7
  ENST ID: ENST00000393167
  CDS Start-End: 226-912
gcggttgcgtagcagctgcgaggacgcggggcgagccggaagtggagtgcgctgcggtgcgagctgggccggcggggtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggacttttgggacacggcaggccaggagcggttccagagcatgcatgcctcctactaccacaaggcccatgcctgcatcatggtgtttgatatacagaggaaagtcacctataggaacctgagcacctggtatacagagcttcgggagttcaggccagagatcccatgcatcgtggtggccaataaaattgatgacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgttttctttccaaagctcacctcggggacaattccttgggcttctcctgaggtaatgattacccccccacccacagctgagtctgtgaggccccatcctttccctacgttttctcccatcttttttcctcttcaatctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaacatt

SEQ ID NO: 172984 - DNA, 1979 bp, Homo sapiens
  Payload ID: 13994
  Gene Symbol: RABL2A
  Gene Name: RAB, member of RAS oncogene family-like 2A
  ENST ID: ENST00000409842
  CDS Start-End: 219-716
gcagctgcgaggacgcggggcgagccggaagtggagtgcgctgcggtgcgagctgggccggcggggtggttcgagagcgcgcagagtccagactggcggcagggcccgaggggccgacccgcagcgtccctggtctctccagccctcactcggaaccgcacacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgttttctttccaaagctcacctcggggacaattccttgggcttctcctgaggtaatgattacccccccacccacagctgagtctgtgaggccccatcctttccctacgttttctcccatcttttttcctcttcaatctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaa

SEQ ID NO: 172985 - DNA, 2282 bp, Homo sapiens
  Payload ID: 13994
  Gene Symbol: RABL2A
  Gene Name: RAB, member of RAS oncogene family-like 2A
  Uniprot ID: Q9UBK7
  ENST ID: ENST00000409875
  CDS Start-End: 303-1019
cgagagcgcgcagagtccagactggcggcagggcccgaggggccgacccgcagcgtccctggtctctccagccctcactcggaaccgcacggtacaggtgaaagggggcagacccctcatcatgctttccaggcatctgccacttcccaggaattgtctccctggataaacaaggcgaagtccctggctgtgcagaagcagtagctgtgtggtggcacagtcaggaaaactcgggggccctgttgacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggacttttgggacacggcaggccaggagcggttccagagcatgcatgcctcctactaccacaaggcccatgcctgcatcatggtgtttgatatacagaggaaagtcacctataggaacctgagcacctggtatacagagcttcgggagttcaggccagagatcccatgcatcgtggtggccaataaaattgatgacataaacgtgacccaaaaaagcttcaattttgccaagaagttctccctgcccctgtatttcgtctcggctgctgatggtaccaatgttgtgaaggtgtggttgactgcagaggtagctagcaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgttttctttccaaagctcacctcggggacaattccttgggcttctcctgaggtaatgattacccccccacccacagctgagtctgtgaggccccatcctttccctacgttttctcccatcttttttcctcttcaatctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttccttttttacagtaaaggctgaatgacataaa

SEQ ID NO: 172986 - DNA, 556 bp, Homo sapiens
  Payload ID: 13994
  Gene Symbol: RABL2A
  Gene Name: RAB, member of RAS oncogene family-like 2A
  ENST ID: ENST00000413545
  CDS Start-End: 215-556
ctgcgaggacgcggggcgagccggaagtggagtgcgctgcggtgcgagctgggccggcggggtggttcgagagcgcgcagagtccagactggcggcagggcccgaggggccgacccgcagcgtccctggtctctccagccctcactcggaaccgcacacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggacttttgggacacggcaggccaggagcggttccagagcatgcatgcctcctactaccacaaggcccatgcctgcatcatggtgtttgatatacagaggaaagtcacctataggaacctgagcacc

SEQ ID NO: 172987 - DNA, 2041 bp, Homo sapiens
  Payload ID: 13994
  Gene Symbol: RABL2A
  Gene Name: RAB, member of RAS oncogene family-like 2A
  ENST ID: ENST00000450954
  CDS Start-End: 195-500
ccggaagtggagtgcgctgcggtgcgagctgggccggcggggtggttcgagagcgcgcagagtccagactggcggcagggcccgaggggccgacccgcagcgtccctggtctctccagccctcactcggaaccgcacacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggcaagaccatccttgtggacttttgggacacggcaggccaggagcggttccagagcatgcatgcctcctactaccacaaggcccatgcctgcatcatgcagacataaacgtgacccaaaaaagcttcaattttgccaagaagttctccctgcccctgtatttcgtctcggctgctgatggtaccaatgttgtgaaggtgtggttgactgcagaggtagctagcaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgttttctttccaaagctcacctcggggacaattccttgggcttctcctgaggtaatgattacccccccacccacagctgagtctgtgaggccccatcctttccctacgttttctcccatcttttttcctcttcaatctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttattgtttcctttttt

SEQ ID NO: 172988 - DNA, 1944 bp, Homo sapiens
  Payload ID: 13994
  Gene Symbol: RABL2A
  Gene Name: RAB, member of RAS oncogene family-like 2A
  ENST ID: ENST00000452831
  CDS Start-End: 172-336
cggtgcgagctgggccggcggggtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggcttccacagcagctgtccacgtacgccctgaccctgtacaagcacacagccacggtagatggcaagaccatccttgtggacttttgggacacggcaggccaggagcggttccagagcatgcatgcctcctactaccacaaggcccatgcctgcatcatgcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggtggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattcaaggcccgtgatacagggatgaggtcagcaccagcaaactctggactggtggaagaattccccaccagatctccttgaagcagaattagggatcagcatcattaacaccttccccaccccctccccccaggcagacagtgaagagaatcagaaaacatgattatgtgtcactttaatacaggaaatttaggtgttttttggtgtttttgtttttgttttctttccaaagctcacctcggggacaattccttgggcttctcctgaggtaatgattacccccccacccacagctgagtctgtgaggccccatcctttccctacgttttctcccatcttttttcctcttcaatctcccagtcatctggtttgtttgtttctttgttcgtcctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagatttccgtgtacccactctgtttcaggagctcttctaggtaaagctgagatcacaggaacagcaggtgacaggcctagctatagttaggaatacacaagcggtaaaatcgagtccttacagccataccacaaggtacgtccatttggactacaagaagagcttcctttaaagttcctatttcagcataaagaggctgtcctttttttttaggaatagtttggaccttgtgcctcctgtgggaggctgaggactgcaagaggagagctagcagatatgcctgttcacccctctctggtacttgtggcttgctagtatgtttttatgataatctcgggcattgtttgcattg

SEQ ID NO: 172989 - DNA, 2140 bp, Homo sapiens
  Payload ID: 13995
  Gene Symbol: RABL2B
  Gene Name: RAB, member of RAS oncogene family-like 2B
  Uniprot ID: Q9UNT1
  ENST ID: ENST00000354869
  CDS Start-End: 179-868
tgcggcgcgagctgggccggcgggcgtggttcgagagcgcgcagagtccagactggcggcagggcccgaggggccgacccgcagcgtccctggtctctccagccctcactcggaaccgcacacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaaca

SEQ ID NO: 172990 - DNA, 2380 bp, Homo sapiens
  Payload ID: 13995
  Gene Symbol: RABL2B
  Gene Name: RAB, member of RAS oncogene family-like 2B
  ENST ID: ENST00000395590
  CDS Start-End: 184-483
ggagtgcgctgcggcgcgagctgggccggcgggcgtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatgtgactgcttcctgcatctgctgcatctccgtgggctcccctcagaccctcttctgaaggcctggggtgtctctcctgccaccatgcctgtgtctgcaggtgcctgccaccagccccagtctgctgcacgggccctggcgagtagaaagcacttgccttctgaccacacggggagctgagggtcagagacggaaccagggctcgaccctccaccttgaaaccttgagatggggatgctcctcattctagccagctcctcctcagctctcaaaacaaggaacagatgctcaggaaaccagacctggacaaaaggcatctgagcctggtgtgaggcagattccagaagtttagttacagacatcctttataaggagtcttcatcgggaattcaagacaacctggtgattcattgaaatttgcctgtgaaagagaatctacatagacttcctgccacctcttgagatgtgacagttgctgaccctcccgccaccacacagggcgagcccctagccctgagcttgaaccgtgttgcttgcacaaatagctgggtgatttagaagtgaggtcagctgtgccagcggttacagggtggtggttgtctgtaactttaatccactgactgttgtactagggcagtttgggctagacactttggaggagctcctgtgaagggcatgaaggctcactgtagcagcagctcagttgtctttcagagttctgcccttaagagctggtttgcagtgctcatccttcttgctgatattttaaaataggtagaaacaggctgggcgcggtgactcatgcctttaatcccagtactttgggaggcctaggcgggcagatcacctgaggtcaggagttcgagaccagcctgaccaacatgttgaaaccccgtctctactagaaatacaaaaattagccaggcgtggtggtgcgcacctgtaatccagctactcaggaggctgagacaggagaatcatttgaagacaggagaatcgtttgaacccaggaggtggaggttgcagtggcagtgagccaagataccgccactgcactctagcctgggcaacagagcaagactccatctcaaaataaatacataaataaataaaaataaaataggtaaaaacaaattataaagtaatacaattatgaactgcaaataataaaacataaaaattactttaaaaaaatttaaagaggccgggcacagtggcttatgcctgtaatcccagaaatttgggaggccgaggcaggaggatcacttgagaccgggagtccaagaccagcctcgttaatataatgagagcttatctctacaaaaaataaacaaaattagccaggcatggtggcatgtgcctgtagttccagctactcaggaggctgaggtaggatcaccggagcccagggggtggaggagcagtaagccaagattctgccactgcactccagcctggctgacagagtaagaccctatctcaaaaaacaaaaagcagaaagaacaaagaagtaaacagaagcttaaaagtaaatcagccaggtgcagtagctcatgcctgtaatcccagtactttgggaggcctaggcaggcagatcactgcaggtcaagagtttgagaccagcctggccaacatgatgaaaccctgtctctactaaaactacaaaaattagccaggcatggtggtgcgcacctgtaatcccagctactccggaggctgagacaagagaatcacttgaacctaggaagtggaggttgcagtggcagtgagccaagatagcgccactgcactccagcctgggcaacagagcaagactccatatatggagatcccttgagatcaagagttcgagaccagcctggccaacatggcaaaaccctgtctctactaaaaataaaaaaa

SEQ ID NO: 172991 - DNA, 1987 bp, Homo sapiens
  Payload ID: 13995
  Gene Symbol: RABL2B
  Gene Name: RAB, member of RAS oncogene family-like 2B
  ENST ID: ENST00000395591
  CDS Start-End: 220-717
gcagctgcgaggacgcgggccgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcacacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaa

SEQ ID NO: 172992 - DNA, 2341 bp, Homo sapiens
  Payload ID: 13995
  Gene Symbol: RABL2B
  Gene Name: RAB, member of RAS oncogene family-like 2B
  Uniprot ID: Q9UNT1
  ENST ID: ENST00000395593
  CDS Start-End: 355-1071
cgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcacggtacaggtgaaagggggcagacccctcatcatgctttccaggcatctgccacttcccaggaattgtctccctggataaacaaggcgaagtccctggctgtgcagaagcagtagctgtgtggtggcacagtcaggaaaactcgggggccctgttgacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgacataaacgtgacccaaaaaagcttcaattttgccaagaagttctccctgcccctgtatttcgtctcggctgctgatggtaccaatgttgtgaaggtgtggttgactgcagaggtagctagcaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaa

SEQ ID NO: 172993 - DNA, 2428 bp, Homo sapiens
  Payload ID: 13995
  Gene Symbol: RABL2B
  Gene Name: RAB, member of RAS oncogene family-like 2B
  Uniprot ID: Q9UNT1
  ENST ID: ENST00000395595
  CDS Start-End: 469-1158
agcagctgcgaggacgcgggccgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcacatggcaaggacacggacaagcaagtcttcgcccgtaagcggtggctcacgcctatagtccagggatgccgaggagggaggatcgcttgagtccaggagttggaggctgcagtgagccgtgatcgcgccaccgcactccagcctgggcgacagagtgagaccctatctctaaacaaaagaaagaacgtcttcaagcatggagccatgaagctggatttggctttctgtcgctctctctacagggtacagacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaa

SEQ ID NO: 172994 - DNA, 2169 bp, Homo sapiens
  Payload ID: 13995
  Gene Symbol: RABL2B
  Gene Name: RAB, member of RAS oncogene family-like 2B
  Uniprot ID: Q9UNT1
  ENST ID: ENST00000395598
  CDS Start-End: 213-899
gctgcgaggacgcgggccgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaa

SEQ ID NO: 172995 - DNA, 2049 bp, Homo sapiens
  Payload ID: 13995
  Gene Symbol: RABL2B
  Gene Name: RAB, member of RAS oncogene family-like 2B
  ENST ID: ENST00000436958
  CDS Start-End: 196-501
ccggaagtggagtgcgctgcggcgcgagctgggccggcgggcgtggttcgagagcgcgcagagtccagactggcggcagggcccgaggggccgacccgcagcgtccctggtctctccagccctcactcggaaccgcacacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatgcagacataaacgtgacccaaaaaagcttcaattttgccaagaagttctccctgcccctgtatttcgtctcggctgctgatggtaccaatgttgtgaaggtgtggttgactgcagaggtagctagcaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttcctttttt

SEQ ID NO: 172996 - DNA, 1868 bp, Homo sapiens
  Payload ID: 13995
  Gene Symbol: RABL2B
  Gene Name: RAB, member of RAS oncogene family-like 2B
  ENST ID: ENST00000425098
  CDS Start-End: 21-326
ctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatgcagacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggtgggtggagcccttttaaaatacccttcccttcaacaactctccagctctgaatggagaaactctctaggccatcccctcttctacctcctgcaacccacccatcctattagcctcccacattctaggcccgtgatacagggatgaggtcagcaccagcaaactctggactggtggaagaattccccaccagatctccttgaagcagaagtagggatcagcatcattaacaccttccccaccccctccccgcaggcagacagtgaagagaatcagaaaacatgattatgtgtcactttaatacaggaaatttaggtgttttttggtgtttttgtttttgtttttgttttctttccaaagctcacctcggggacaattccttgggcttctcctgaggtaatgatttacccccccacccacagctgagtctgtgaggccccatcctttccctacgttttctcccatcttttttcctcttcagtctcccagtcatctggtttgtttgtttctttgttcgttctgagacggagtctcgctctgtcgccaggctggagtgcagtggcgcagtctcggctcgctgcaacctctgactccctggttcaaacgattctcctgcctcagcctcccgagtggctggcatcaccacgcccagctaatttttgtatttttagtagagacggggtttcaccatgttgcccaggatggtctcgatctcctcacctcgtgatccgcccgcctcggcctcccaaagtgctgggattacaggcatgagccaccgcgcccggccccaatcatctgtttttaaacaatcgtttttgagcagatagctattcattccagattttcgtgtacccattctgtttcaggagctcttctaggtaaagctgagatcacaggaacagcaggtgacaggcctagctatagttaggaatacacaagccgtaaaatcgagtccttacagccataccacaaggtacgtccatttggactacaagaagagcttcctttaaagttcctatttcagcataaagaggctgtccttttttttgaggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaa

SEQ ID NO: 172997 - DNA, 1126 bp, Homo sapiens
  Payload ID: 13995
  Gene Symbol: RABL2B
  Gene Name: RAB, member of RAS oncogene family-like 2B
  Uniprot ID: Q9UNT1
  ENST ID: ENST00000435118
  CDS Start-End: 216-902
gcagctgcgaggacgcgggccgagccggaagtggagtgcgctgcggcgcgagctgggccggcgggcgtggttcgagagcgcgcagagtccagactggcggcagggcccgaggggccgacccgcagcgtccctggtctctccagccctcactcggaaccgcactgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatggtgtttgatgtacagaggaaagtcacctataggaacctgagcacctggtatacagagcttcgggagttcaggccagagatcccatgcatcgtggtggccaataaaattgatgacataaacgtgacccaaaaaagcttcaattttgccaagaagttctccctgcccctgtatttcgtctcggctgctgatggtaccaatgttgtgaagctcttcaatgatgcaattcgattagctgtgtcttacaaacagaactcccaggacttcatggatgagatttttcaggagctcgagaacttcagcttggagcaggaagaggaggacgtgccagaccaggaacagagcagcagcatcgagaccccatcagaggaggcggcctctccccacagctgaggggctggggctaggggaatagtttggaccttgtgcctcctgtgggaggctgaggactgcaagaggagagctagcagatatgcctgttcacccctctctggtacttgtggcttgctagtatgtttttatgataatctcgggcattgtttgcattgtgtttattaatagggttttgtttttgttgtttccttttttacagtaaaggctgaattacataaacattg

SEQ ID NO: 172998 - DNA, 391 bp, Homo sapiens
  Payload ID: 13995
  Gene Symbol: RABL2B
  Gene Name: RAB, member of RAS oncogene family-like 2B
  ENST ID: ENST00000413505
  CDS Start-End: 331-391
ggtacaggtgaaagggggcagacccctcatcatgctttccaggcatctgccacttcccaggaattgtctccctggataaacaaggcgaagtccctggctgtgcagaagcagtagctgtgtggtggcacagtcaggaaaactcgggggccctgttggtattttctacccctgacccgtgtgcatacttctgtcgtagctctcaccacagtagactctgctatcattgtgtcttccatcctctgaaccctgtgcaaggtctgctcatggtgaatgcccatgacaataccctcccctcccttgggctggacccctctctacagctaggagccaatggcagaagacaaaaccaaaccgagtgagttggaccaagggaagtatgatgctgatgaca

SEQ ID NO: 172999 - DNA, 561 bp, Homo sapiens
  Payload ID: 13995
  Gene Symbol: RABL2B
  Gene Name: RAB, member of RAS oncogene family-like 2B
  ENST ID: ENST00000468451
  CDS Start-End: 158-277
gggcgtggttcgagagcgcgcagagtccagactggcggcagggcccgaggggccgacccgcagcgtccctggtctctccagccctcactcggaaccgcacacagtgacaataccctcccctcccttgggctggacccctctctacagctaggagccaatggcagaagacaaaaccaaaccgagtgagttggaccaagggaagtatgatgctgatgacaacgtgaagatcatctgcctgggagacagcgcagtgggcaaatccaaacacaacaattagaaaacaaggcagtcttcatccactagcagtatctcaggcaaaaggttgtcccagatacaaagaccatggtggaaacagtgcatctgagggaagactcatggagagatttctcatggatggctttcagccacagcagctgtccacgtacgccctgaccctgtacaagcacacagccacggtagatggaaggaccatccttgtggacttttgggacacggcaggccaggagcggttccagagcatgcatgcctcctactaccacaaggcccacgcctgcatcatgg

SEQ ID NO: 173000 - DNA, 3883 bp, Homo sapiens
  Payload ID: 13996
  Gene Symbol: RABL3
  Gene Name: RAB, member of RAS oncogene family-like 3
  Uniprot ID: Q5HYI8
  ENST ID: ENST00000273375
  CDS Start-End: 31-741
aggcgttaacccagggaaggcagtggcaagatggcgtccctggatcgggtgaaggtactggtgttgggagactcaggtgttgggaaatcttcgttagtccatctcctatgccaaaatcaagtgctgggaaatccatcatggactgtgggctgctcagtggatgtcagagttcatgattacaaagaaggaaccccagaagagaagacctactacatagaattatgggatgttggaggctctgtgggcagtgccagcagcgtgaaaagcacaagagcagtattctacaactccgtaaatggtattattttcgtacacgacttaacaaataagaagtcctcccaaaacttgcgtcgttggtcattggaagctctcaacagggatttggtgccaactggagtcttggtgacaaatggggattatgatcaagaacagtttgctgataaccaaataccactgttggtaatagggactaaactggaccagattcatgaaacaaagcgccatgaagttttaactaggactgctttcctggctgaggatttcaatccagaagaaattaatttggactgcacaaatccacggtacttagctgcaggttcttccaatgctgtcaagctcagtaggttttttgataaggtcatagagaagagatactttttaagagaaggtaatcagattccaggctttcctgatcggaaaagatttggggcaggaacattaaagagccttcattatgactgaattacactcatcctttggaagagtgagcaagcagtggcagtttttcacagctcatcttgctgtgttcaattattaccatcacagccttttaacaaaatcatcttaaaatgctacccttcagccttaccctttaatggaaaaatgaaaggaagtgacaatacgggaggtccaaactttgtccctgttctctgtgttccttacctttctgtccctgtgtatagattatgtaaaagccttgtgtaaatatgagatgttgtcaaaatgatgcagtaaatgagcaatgacagtgtactgcagagaaaatttactcttgcctagaactggagggtttttatgggtctgtaattttcccacactcattgctgaaagcttaattaagtacttcaaaaacgtatctccattgttttaccttcttgaggggaacggtcttgttaaccagccctgagttgtctaccccaaacaatctctgtcattttcaaagatgcaaaatggtgttatttaattgtctccaccattgtcacacacaggaatgcctaataatagcaacccttgtctccctcttctctcctttgcaaatggctcagtgactggaagaggcggactaatagccagagttaaatataaatacaaattaataatacatagagaacagcaataccagaaaaaaagaattctggtaaaatgatgtgaaaaattgacagctccctcactcttaaggttgctgctatatacagtctaggttttctgtttggaaataggtagggtaaaatctaagacctgcacaagggcagtgagagacatttacagcctcctctctatttgtttttttaaggaaaagtcaactcctgaaatgtcccttagctataatcagaaaactaagaatattattctgtgtcaacaatgtatttatggagagaagtaaaaataagttccacagcaacacatttacatgaattatgaactaggattcttggatttcataatcactccaaagctttttggggatggtgtgtgtgtgtgtgtgtgtccgtaattgttcatcattactttttttaacctatctttttgcttgcttaatcttctctgccccagttcttcctgagtatatgaatttgatttctaaaaacaatttattcaacactctatcacccgtattctctctctggctctgctgcaggtctctgcactcctgattttgctccatacttttaaataacaataataaatatacagttttcatttctcatttaaaaaataggtggaaaacaccaaattcactttctgttccattttaattaggtttcagaagtatcttggaaatcaaggtatgctgcaagaggatattaaaataagaatgttagagagtccttttagaaaggcagtcttgggaatttggaaaaggatttttaaagcagctttcatcagctagactgttctccagcctttctttacttcctctttgaaaggacatagccctggtttctttttgacacaaaggaaagctatgcaaatcatgatctgtatgtagaattggtcacaagtatgttgttgcataggctgtacagttgggaagtagaaaccaaatgctacccagagacctaacccaattaagctctttgtatttctccttcaagaaataaatcttccttccttctttcttcctctttcttttaattttaaaaaaattcatcctgatttttttattttctatcttatttaaaaaataaaaataggccaggcgcggtggctcacacctttaatcccaacactttgggaggcgggtcgatcacttgatatcaggagtttgagaccagcctggccaacatagggaaaccctgtctctactaaaaatacaaaaattagccaggcctggtggcacgcgcctgtaatcccagctacttgggaggctgaggcaggagaatcacttgaacctgggaggtggaggttgcagtgagtcaagatcgtgtcactgcactccagcctaggtgacagagtgagactccaactaaaagaaaataaataaataaatatataaatatataaataaataataaaagtaaactattgctgatgactccagggtcaatctggaaaaattaacagtattcctcaactccattactttctgcagccaagcttgattccttgaattatagttttctaagaaaaaatagtttttaataatctaaggtaaatttgttgcaattattagcagcagcataataaggctttttgcgcaaatgaatgttattagctagagttattcaaaaaagaatgaagcacaatttttgctaggacttcttgagaactattcataaaaatgcttttagataataaacaagtataaatgtcaaaatatttttttaaaagtataattggccaggtgctggctcacgcctataatcccagcactctaggagactgaggcaggaggatcacttgagctcgggagtttgaggctgcagtgattcatgattgcaccactgccttccagcagcctgatgacagagtgggactccatctctttacatatgtatatcttactctcttgatgggacaagttggtagaaataaagattttttttttctgttgtgatttcggtgtctgaccaattttctgactcattgtgaaggtgaccagatatgaaggcatatatatgactactcctctgtcccttaggtgtataagacttagctggaatccaactaaagatttgggctggtctctccatcttaacgttgatgggattcaggacacataaccccaaaatattgcaccctgttatttgagaaaactgcagaagcaaggtttctcataccttccccttaccccttctcccctgaagcaggccataaaccctaagtgactgttccctgaagtagatcataaaaccttcattccataggtaccctttatcctcacagatacagagacaccaagaagaatctggacaaataggacttgctaagttctccacagtttattaccattagattatgtccttttgtcctctgattatacttctgcataagactgtacataaaaatacacaagttttcctatttcttttttgtcttcatttctgaagattcctgtcatgtaaaacttacagtaaataaatgtgtgtgcttttctcaataa

SEQ ID NO: 173001 - DNA, 1715 bp, Homo sapiens
  Payload ID: 13996
  Gene Symbol: RABL3
  Gene Name: RAB, member of RAS oncogene family-like 3
  ENST ID: ENST00000485161
  CDS Start-End: 8-169
tggcaagatggcgtccctggatcgggtgaaggtactggtgttgggagactcaggtgttgggaaatcttcgttagtccatctcctatgccaaaatcaagtgctgggaaatccatcatggactgtgggctgctcagtggatgtcagagtattattttcgtacacgacttaacaaataagaagtcctcccaaaacttgcgtcgttggtcattggaagctctcaacagggatttggtgccaactggagtcttggtgacaaatggggattatgatcaagaacagtttgctgataaccaaataccactgttggtaatagggactaaactggaccagattcatgaaacaaagcgccatgaagttttaactaggactgctttcctggctgaggatttcaatccagaagaaattaatttggactgcacaaatccacggtacttagctgcaggttcttccaatgctgtcaagctcagtaggttttttgataaggtcatagagaagagatactttttaagagaaggtaatcagattccaggctttcctgatcggaaaagatttggggcaggaacattaaagagccttcattatgactgaattacactcatcctttggaagagtgagcaagcagtggcagtttttcacagctcatcttgctgtgttcaattattaccatcacagccttttaacaaaatcatcttaaaatgctacccttcagccttaccctttaatggaaaaatgaaaggaagtgacaatacgggaggtccaaactttgtccctgttctctgtgttccttacctttctgtccctgtgtatagattatgtaaaagccttgtgtaaatatgagatgttgtcaaaatgatgcagtaaatgagcaatgacagtgtactgcagagaaaatttactcttgcctagaactggagggtttttatgggtctgtaattttcccacactcattgctgaaagcttaattaagtacttcaaaaacgtatctccattgttttaccttcttgaggggaacggtcttgttaaccagccctgagttgtctaccccaaacaatctctgtcattttcaaagatgcaaaatggtgttatttaattgtctccaccattgtcacacacaggaatgcctaataatagcaacccttgtctccctcttctctcctttgcaaatggctcagtgactggaagaggcggactaatagccagagttaaatataaatacaaattaataatacatagagaacagcaataccagaaaaaaagaattctggtaaaatgatgtgaaaaattgacagctccctcactcttaaggttgctgctatatacagtctaggttttctgtttggaaataggtagggtaaaatctaagacctgcacaagggcagtgagagacatttacagcctcctctctatttgtttttttaaggaaaagtcaactcctgaaatgtcccttagctataatcagaaaactaagaatattattctgtgtcaacaatgtatttatggagagaagtaaaaataagttccacagcaacacatttacatgaattatgaactaggattcttggatttcataatcactccaaagctttttggggatggtgtgtgtgtgtgtgtgtgtccgtaattgttcatcattactttttttaacctatctttttgcttgcttaatcttctctgccccagttcttcctgagtatatgaatttgatttctaaaaac

SEQ ID NO: 173002 - DNA, 833 bp, Homo sapiens
  Payload ID: 13996
  Gene Symbol: RABL3
  Gene Name: RAB, member of RAS oncogene family-like 3
  ENST ID: ENST00000481015
  CDS Start-End: 1-160
ggcgtccctggatcgggtgaaggtactggtgttgggagactcaggtgttgggaaatcttcgttagtccatctcctatgccaaaatcaagtgctgggaaatccatcatggactgtgggctgctcagtggatgtcagagtattattttcgtacacgacttaacaaataagaagtcctcccaaaacttgcgtcgttggtcattggaagctctcaacagggatttggtgccaactggagtcttggtgacaaatgggactgcacaaatccacggtacttagctgcaggttcttccaatgctgtcaagctcagtaggttttttgataaggtcatagagaagagatactttttaagagaaggtaatcagattccaggctttcctgatcggaaaagatttggggcaggaacattaaagagccttcattatgactgaattacactcatcctttggaagagtgagcaagcagtggcagtttttcacagctcatcttgctgtgttcaattattaccatcacagccttttaacaaaatcatcttaaaatgctacccttcagccttaccctttaatggaaaaatgaaaggaagtgacaatacgggaggtccaaactttgtccctgttctctgtgttccttacctttctgtccctgtgtatagattatgtaaaagccttgtgtaaatatgagatgttgtcaaaatgatgcagtaaatgagcaatgacagtgtactgcagagaaaatttactcttgcctagaactggagggtttttatgggtctgtaattttcccacactcattgctgaaagcttaattaagtacttcaaaaacgtatctccattgtt

SEQ ID NO: 173003 - DNA, 2370 bp, Homo sapiens
  Payload ID: 13996
  Gene Symbol: RABL3
  Gene Name: RAB, member of RAS oncogene family-like 3
  ENST ID: ENST00000473654
  CDS Start-End: 487-876
ggcgcagccaagcccgccctacccgaggtcgcacacgggccgctccggggtcaatggttctttggaggaccaagaggaccaaggcaacagggtaattcattaggggaggatagttaagagggagcgaaaggaagaagaaatcatgaaatgcaatgcccggccagggaactccgaacaaggaacagggaacaaggtttaccaaggcgaatcctggaacactcccactacagctgcccccagcgcttcaactaccggcttaaatgaaccacgccccttgcgcgacaaagaaaacgcactattcctgcgaccagctggggaagcaccccgctaccttttaccagaccagccaatgagttcagtgaaaccttcgatcaagacagtcacgctccgagtggccaatgaaattgaaggctctgccctccatgcccaactctgattggcttacaatccaggaacaggcgttaacccagggaaggcagtggcaagatggcgtccctggatcgggtgaaggtactggtgttgggagactcaggtgttgggaaatcttcgttagtccatctcctatgccaaaatcaagtgctgggaaatccatcatggactgtgggctgctcagtggatgtcagagttcatgattacaaagaaggaaccccagaagagaagacctactacatagaattatgggatgttggaggctctgtgggcagtgccagcagcgtgaaaagcacaagagcagtattctacaactccgtaaatggtattattttcgtacacgacttaacaaataagaagtcctcccaaaacttgcgtcgttggtcattggaagctctcaacagggatttggtgccaactggagtcttggtgacaaatggggactaaactggaccagattcatgaaacaaagcgccatgaagttttaactaggactgctttcctggctgaggatttcaatccagaagaaattaatttggactgcacaaatccacggtacttagctgcaggttcttccaatgctgtcaagctcagtaggttttttgataaggtcatagagaagagatactttttaagagaaggtaatcagattccaggctttcctgatcggaaaagatttggggcaggaacattaaagagccttcattatgactgaattacactcatcctttggaagagtgagcaagcagtggcagtttttcacagctcatcttgctgtgttcaattattaccatcacagccttttaacaaaatcatcttaaaatgctacccttcagccttaccctttaatggaaaaatgaaaggaagtgacaatacgggaggtccaaactttgtccctgttctctgtgttccttacctttctgtccctgtgtatagattatgtaaaagccttgtgtaaatatgagatgttgtcaaaatgatgcagtaaatgagcaatgacagtgtactgcagagaaaatttactcttgcctagaactggagggtttttatgggtctgtaattttcccacactcattgctgaaagcttaattaagtacttcaaaaacgtatctccattgttttaccttcttgaggggaacggtcttgttaaccagccctgagttgtctaccccaaacaatctctgtcattttcaaagatgcaaaatggtgttatttaattgtctccaccattgtcacacacaggaatgcctaataatagcaacccttgtctccctcttctctcctttgcaaatggctcagtgactggaagaggcggactaatagccagagttaaatataaatacaaattaataatacatagagaacagcaataccagaaaaaaagaattctggtaaaatgatgtgaaaaattgacagctccctcactcttaaggttgctgctatatacagtctaggttttctgtttggaaataggtagggtaaaatctaagacctgcacaagggcagtgagagacatttacagcctcctctctatttgtttttttaaggaaaagtcaactcctgaaatgtcccttagctataatcagaaaactaagaatattattctgtgtcaacaatgtatttatggagagaagtaaaaataagttccacagcaacacatttacatgaattatgaactaggattcttggatttcataatcactccaaagctttttggggatggtgtgtgtgtgtgtgtgtgtccgtaattgttcatcattactttttttaacctatctttttgcttgcttaatcttctctgccccagttcttcctgagtatatgaatttgatttctaaaaacaatttattcaacactctatcacccgtattctctctctggctctgctgcaggtctctgcactcctgattttgctccatacttttaaataacaataataaa

SEQ ID NO: 173004 - DNA, 760 bp, Homo sapiens
  Payload ID: 13996
  Gene Symbol: RABL3
  Gene Name: RAB, member of RAS oncogene family-like 3
  ENST ID: ENST00000483733
  CDS Start-End: 14-652
aggcagtggcaagatggcgtccctggatcgggtgaaggtactggtgttgggagactcaggtgttgggaaatcttcgttagtccatctcctatgccaaaatcaagtgctgggaaatccatcatggactgtgggctgctcagtggatgtcagagttcatgattacaaagaaggaaccccagaagagaagacctactacatagaattatgggatgttggaggctctgtgggcagtgccagcagcgtgaaaagcacaagagcagtattctacaactccgtaaatggtattattttcgtacacgacttaacaaataagaagtcctcccaaaacttgcgtcgttggtcattggaagctctcaacagggatttggtgccaactggagtcttggtgacaaatggggattatgatcaagaacagtttgctgataaccaaataccactgttggtaatagggactaaactggaccagattcatgaaacaaagcgccatgaagttttaactaggactgctttcctggctgaggatttcaatccagaagaaattaatttggtcatagagaagagatactttttaagagaaggtaatcagattccaggctttcctgatcggaaaagatttggggcaggaacattaaagagccttcattatgactgaattacactcatcctttggaagagtgagcaagcagtggcagtttttcacagctcatcttgctgtgttcaattattaccatcacagccttttaacaaaatcatcttaaaa

SEQ ID NO: 173005 - DNA, 839 bp, Homo sapiens
  Payload ID: 13996
  Gene Symbol: RABL3
  Gene Name: RAB, member of RAS oncogene family-like 3
  ENST ID: ENST00000465022
  CDS Start-End: 4-411
aagatggcgtccctggatcgggtgaaggtactggtgttgggagactcaggtgttgggaaatcttcgttagtccatctcctatgccaaaatcaagtgctgggaaatccatcatggactgtgggctgctcagtggatgtcagagttcatgattacaaagaaggaaccccagaagagaagacctactacatagaattatgggatgttggaggctctgtgggcagtgccagcagcgtgaaaagcacaagagcagtattctacaactccgtaaatggtattattttcgtacacgacttaacaaataagaagtcctcccaaaacttgcgtcgttggtcattggaagctctcaacagggatttggtgccaactggagtcttggtgacaaatgggactgcacaaatccacggtacttagctgcaggttcttccaatgctgtcaagctcagtaggttttttgataaggtcatagagaagagatactttttaagagaaggtaatcagattccaggctttcctgatcggaaaagatttggggcaggaacattaaagagccttcattatgactgaattacactcatcctttggaagagtgagcaagcagtggcagtttttcacagctcatcttgctgtgttcaattattaccatcacagccttttaacaaaatcatcttaaaatgctacccttcagccttaccctttaatggaaaaatgaaaggaagtgacaatacgggaggtccaaactttgtccctgttctctgtgttccttacctttctgtccctgtgtatagattatgtaaaagccttgtgtaaatatgagatgttgtcaaaatgatgcagtaaatg

SEQ ID NO: 173006 - DNA, 3091 bp, Homo sapiens
  Payload ID: 13997
  Gene Symbol: RABL6
  Gene Name: RAB, member RAS oncogene family-like 6
  Uniprot ID: Q3YEC7
  ENST ID: ENST00000311502
  CDS Start-End: 237-2426
gactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcagagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 173007 - DNA, 1820 bp, Homo sapiens
  Payload ID: 13997
  Gene Symbol: RABL6
  Gene Name: RAB, member RAS oncogene family-like 6
  Uniprot ID: Q3YEC7
  ENST ID: ENST00000357466
  CDS Start-End: 39-1601
cgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 173008 - DNA, 2379 bp, Homo sapiens
  Payload ID: 13997
  Gene Symbol: RABL6
  Gene Name: RAB, member RAS oncogene family-like 6
  Uniprot ID: Q3YEC7
  ENST ID: ENST00000371663
  CDS Start-End: 231-2379
tggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagcagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcagagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccc

SEQ ID NO: 173009 - DNA, 1580 bp, Homo sapiens
  Payload ID: 13997
  Gene Symbol: RABL6
  Gene Name: RAB, member RAS oncogene family-like 6
  Uniprot ID: Q3YEC7
  ENST ID: ENST00000371671
  CDS Start-End: 255-1199
cgccaagatggcggcgctgactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagaaggatgtcaggcttgcccaggaaaggggctgtgctgtcgtcctggtgtcagaagaagtgaggatgcctgcaggctgggactgctgctggggacgtttgggttggaaggaaggcggcagtcagacttgtcctgtgccggcactgctggggaggcccctccttcctgcagagccgtcccctcatcactgggttgattactccttagagagctccccactgctcagctgctccattccctaatggtttgccctccaaacccttccaaagcctcccagggagagaacgggaccctggacagagtcttgagctggaagcgtagggctgagctgtgtgtgactatccttttgctatggatgtgttcaagcagatctgatgtcctcgcctgtctcagcagcgggacccctgtttcctctttgtcttgcccctggattgcctggaagcaaatttcaggccttctttatgtcacctaaaaatatttcaaacacatctctaaaaaaatcagttgtttttttaacctgaccgtagtacctaatgtaataccgcatgttaaactcacagaaggtttttcttggagaaataagccacaataacaaattgaaaaaataaaattcccaaagagtt

SEQ ID NO: 173010 - DNA, 2547 bp, Homo sapiens
  Payload ID: 13997
  Gene Symbol: RABL6
  Gene Name: RAB, member RAS oncogene family-like 6
  ENST ID: ENST00000436380
  CDS Start-End: 1-646
gaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagcagacctccaggttcctcctacttccgctatgctgagtcttccatgaagaacagcttcggcctaaagtaccttcataagttcttcaatatcccatttttgcagcttcaggtaagcactcaccacgtggggtggagtggctgctggtctctcacctccttccaggtgtctcctgtgtagcaacgggtctccctcctaacccctgagaaagctgtggacctgctcggagattggctgctggcaagggcccagcgttctactgcacctgcctgctctgggtggcagagggtacagggtcctgagggctagacccagtcccaggagcccctccacctctgcggggaccccttgctcagtttcccccagtgtttttggttgtttttgtttgttgagataaggtcttgctgtgtggcccaggctggagtgcagtggcgcaatcatggctcactgcggcctcaaactccggggctcaggcaatcctcccacctgtctcccaaagtgctgggatgccaggcgtgagtcaccgaggtactcgctgttcacatctcacatttccctggtgcttgtgtcaaaaccaaggaaccaactttggcctacggactaaactcactttcctttgtagaaacaagggccaggccagctgtggctgcaaagtagcccagcaaatgatgaggcttgaacctcctcgccctgggctgccctgattgggtctgggggacctgaacctcctcgccctgggctgccctgactgggtctgggggacctgaacctcctcgccctgggctgccccagctgggtctggggacctgaacctcctcgccctgggctgccccgcctgggtctggggacctgaacctcctcgccctgggctgccccgcctgggtctggggacctgaacctcctcgccctgggctgccccacctgggtctggggacctgaacctcctcgccctgggctgccccagctgggtctgggggacctgaacctcctcgccctgggctgccccagctgggtctgggggacctgaacctcctcgccctgggctgccccagctggatctgggggacctgaacctcctcgccctgggctgccccgcctgggtctgggggacctgaacctccttgcctgggctgccccgcctgggtctgggggacctgaacctcctcgccctgggctgccccagctgggtctgggggacctgtacctcctcgccctgggctgccccgcctgggtctgggggacctgaacctcctcgccctgggctgccccgactgggtctgggggacctgaatctcctcaccctgggctgccccagctgggtctggggacctgaacctcctcgccctgggctgccccagctgggtctgggggacctgaacctcctcgccctgggctgccccgactgggtctgggggacctggggcccagctgcagctgcagcagccttggtctttctccagaaggatgtcaggcttgcccaggaaaggggctgtgctgtcgtcctggtgtcagaagaagtgaggatgcctgcaggctgggactgctgctggggacgtttgggttggaaggaaggcggcagtcagacttgtcctgtgccggcactgctggggaggcccctccttcctgcagagccgtcccctcatcactgggttgattactccttagagagctccccactgctcagctgctccattccctaatggtttgccctccaaacccttccaaagcctcccagggagagaacgggaccctggacagagtcttgagctggaagcgtagggctgagctgtgtgtgactatccttttgctatggatgtgttcaagcagatctgatgtcctcgcctgtctcagcagcgggacccctgtttcctctttgtcttgcccctggattgcctggaagcaaatttcaggccttctttatgtcacctaaaaatatttcaaacacatctctaaaaaaatcagttgtttttttaacctgaccgtagtacctaatgtaataccgcatgttaaactcacagaaggtttttcttggagaaataagccacaataacaaattgaaaaaataaaattcccaaagagtt

SEQ ID NO: 173011 - DNA, 3969 bp, Homo sapiens
  Payload ID: 13997
  Gene Symbol: RABL6
  Gene Name: RAB, member RAS oncogene family-like 6
  ENST ID: ENST00000432842
  CDS Start-End: 2345-2917
gttcccgcaggggtgctgggcccctgcggctcccaccacattgcgctggactcttgtggcccgtgctgacctggtgttccagatgctgtctctgcagagctctgcgtggtctctggtgttagagaggtggccacccaccgccctatcattgtcctcatccccactgtgaggagaagctatcagatctgcctgtggcccccaggtggctcaggaagggccgtcctgacccccatcctggcccctttcggagctgcagagatttcctgtgcctccagctctggcttcctgggtctgtccttggcgtggagcgggcacaggcttcccgtagacacggttgcccagagtggggttcataactgggcactgtaaagggtgtggtctccacggcttaggatgggcccccccttcctggtggcctgctgtgcccggggctggtgtggaggcctgtgggtgcagaggccgcctggccctgggcttcctctggggttacatgtgtacccttgcacccacctgttagcacccaccgggagagtctcactcagcctaaaccagggcccctcaggaggaaaaggtccccagcttcatgatggggcccagtgtgccttccatccccgccctgactcagtgcccactgtgcgaggtgtgagcactgtccacagcagccagggcggccggtggggagtgcattggagggggttgaggtctcttgggcacctggtgagttctcaagggtgagaggaagccgaggccatcaggcttagctgacgctgcatggggcaggctgccaagagggaggctgaatggagcagcctcaggtgagccgacaatcctcacctccgcctggtcagccaggacccggctcccctccagtcccgcctgctttccccaaagcagatccagccagtctcaatggctcgcccggggggtgctggttaggctgtgagcatccttcctgggtgcaggcccccgacagccagcagtgctgtgctgtgtgtgtgttggggactctgctgagccctttgtggccagactggggaggctcctccgggctggctctgtcccctgtaccttgtgagggaggggctgaccccctgactgggttacatcgtggtgagcagttcagaaacaagctgtggaatgaagtggacgtggcgttttaaacacatgagccccatctgttcttaggggttttgtttgttgtcccagtccgtgactccaagactgggacccccagagttcccaggatggtctggagcctttatcctcaggtcagcattgtggagttaaagggaggggaccacggcccctcattctcaggagagccatggtgaccttgatggcggaggctcagggggacctggaccgtggacaccacacagctgccctcctccctcccgaggccatttcagggctggaatccctgcccccctctcctttcctcccgggctggttgttgccttgagagtccgtgcgctcatctccccacttttaccccagggggaggcccctcaccttcccaccatatcccttgtacttcctcccaccctggacttgggggagctggggggagggggcccttccttcagcagcaaaccctcctggtgtagggctgtaggccatcccaccgcagcctgtccaggagctgctgagcctgtcagccccaactagcacctcctgtccaggcccggcccagccctgcctccagagcctacagaggggcctcgcccaggtcctgctgctccagagcttgtgggtgcccacgctgcaggctgtttggggtggtggagtagagcacccgctggagctgggggctgagtggccatggggggaccatgctcctcctatggcccaaggcccaggggttccacctcgtaatttttgtttgtttttaaataaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacaggtgggtgcggtggccctgctcccgagggaccctgcccggtgctccggtgtgcgggggagggtgctgaggcagaggcccagggaggggttaacgttagcatggggcccggcggatgtgggtctcgccgctgagtggggctcactgaagcctgggtctccccgatggcagggccgggaactgtgtgctggggaactgtgtgccagggtgaagtgctggcactgtggggtcacctgcagaagggcactcggcttagctgcttagcagggctcagcagggtcctgtggcctcaggagcctgcaggaggagggagggcagtgcggacccacagctgtgggcccaggggtgatccttggcaccagggcaagggtctttctcttgcatcttttttcctttctgaaagcagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatgtatgtggccggacccgcccgtgcgggcggtgtgggggctgcgggcgtggccgtggtgcagggccatgggctgcaccaaggagacagcagaggggagtgtcccctgtttggggtaaattagtcacctttgggcacgggtggaggaggactcaggtttgcactgcccccagcagcccccccacagtcacccctggcgtggactcctcatacaggtcatgctgtgcctgccactctgagtaccgctgaccgtggccaggtgctggtgctcatggagtgctgctggggctgcctgcccatcaggggcttggcctcccagattgatgccagcatggggtgtgctttctggggagctgcttgactttgggaagctccctgtgttgaagaggcatacaggccaggacatggaggtctctggtcctcgatagcagagggcggctcagagcatcctcctgagtgggcctgggcagtgcatagccccggggttgcggccagtgggacagctggcccgttctctgcctcaggctcctgtacagctaggggcttggtgcctcccctgggacccaggcagggaccacggaatcagtggccctcctgaggccccccaggaggtctctgtttccagaaggagagccctgtgggtcaccttggatctggctgttggctcagacacagcaagagaccgagagggaaggcagtttgatgcctggagagggacccgtggcttccagctgccaggccagccccagaatggagccccccgcatgggcgcttctctgttgaaccaatcctggcatttcctgggcctgagagttgggtcagctggatgctgcgatggccgcacgtgctccaccaagccccagccccctcctcttcccagaaacccccgctcacgggaaggtccagttgctgccatctggccacctctgcatggagcccccaacagctgtgcctcagaacagatccgaagtgactttcaggggagctggacacatgtacgctggtgcctgctgtccccaccctttggcactgctgctctttctttttctgagatggagtctcgctctgtcgcccaggctggagcgcagtggtgtgatctcggctcaccgcaagctccgcctcccgggttcacgccattctcctgcctcagcctcccaagtaatggggaggctgagg

SEQ ID NO: 173012 - DNA, 3361 bp, Homo sapiens
  Payload ID: 13997
  Gene Symbol: RABL6
  Gene Name: RAB, member RAS oncogene family-like 6
  ENST ID: ENST00000464941
  CDS Start-End: 713-2128
actcccgggaaagacccggagacgggaccaccgcatgtggaaaccaccgggaagcacagcgcgtgggccgcctgagcggtgccggggcggggaggcagggccgccgctcaggccgtggacctcggggccgcgggacggacgtggatggcgccgccgttctctcgcgggcccagcgaggctatgcgtgcgcggcccgggcagtctctgcgagcccgggctgctgctcatctgggggggacggcggccgcccgactgagcccagagctgtgggccgcgcccgggttcctgcctcgggccggaggagggagggcgccgcggcccgtctcgggcctcccgccgcgctggggcctggctccctcctggctgcgctgagcgcctgcggctccgcttggggctgctgtgctctccacaggccgggccgccgggctggagggcgctgcaggcggcctctgttctccaagttctccgcgggagagggaggggaacgagggcccagccttccgcggggtgggctcggccgggagaagcgcggagcctcctggctgcccccagccggtgcggccgccaccgtggccgtgagggcgcctgggtcccctctggaggttttgccgcagcgctggccggcgccgagatatgaccagaggcgttgaaagttggcgcgttgaggtacctaggatgggcgaggaaatgaacaagcttcaggggagaagaaatgactgtgggaacagtgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcagagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttcactctg

SEQ ID NO: 173013 - DNA, 2746 bp, Homo sapiens
  Payload ID: 13997
  Gene Symbol: RABL6
  Gene Name: RAB, member RAS oncogene family-like 6
  ENST ID: ENST00000484471
  CDS Start-End: 237-1691
gactcctggagagcggtcgcgccggaggccgcgggggccggagcggagcagccgcggctgaggttcccgagtcgccgctcggggctgcgctccgccgccgggaccccggcctctggccgcgccggctccggcctccgggggggccggggccgccgggacatggtgccagtcgcaccccttccccgccgccgctgagctcgccggccgcgcccgggctgggacgtccgagcgggaagatgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcagagggcccagcaacggtccagagtgtggaggactttgttcctgacgaccgcctggaccgcagcttcctggaagacacaacccccgccagggacgagaagaaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctaggccggcgtgggcagtggccgccctggggcggggggcgtgcctgtcactgcctggggaggcatttgcctctgtaccatcgcctttgccgctgccccgtggctgccgtgtgcgcttctgagctggaagaggccgggcattggtggtccccaggctgggccctgcaggtgctgggccttcaggcccagtgtgagcctgctctgcaagaagggaggggacagctggcttcagccaggctcggtggacaccctggccctctcggggcagagccgccagtgtttctcagggatgtgactgaggcccaggagggacctgtgagggtctgtttacagaggctgggcaggggccgcttggctgtggggtgtgcgctgccccggcacctgcttgccctccgcgctcatctggggccgcagcatgcctatggttccgcttccggccgggagccctgaacacgggtgtgcagactcaccctaaagggcggcccaggccccacgctagaaggctggcgagaccgaaggcagcatgtgaggcctctcctgggagtgggggttgtgtttcccacagtggcctcagctgcgcccccgctcaggtgagcccgaaggcaggagccgggaggcactcctcccaaacactccactcagaccataaagcactcctgtttca

SEQ ID NO: 173014 - DNA, 1416 bp, Homo sapiens
  Payload ID: 13997
  Gene Symbol: RABL6
  Gene Name: RAB, member RAS oncogene family-like 6
  ENST ID: ENST00000629216
  CDS Start-End: 1-1416
atgactgtgggaacagtgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcagagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtccggagaagcgcagcagcaccaggccccctgctga

SEQ ID NO: 173015 - DNA, 2193 bp, Homo sapiens
  Payload ID: 13998
  Gene Symbol:
  Gene Name: RAB, member RAS oncogene family-like 6 [Source:EntrezGene
  Acc:55684]
  ENST ID: ENST00000425121
  CDS Start-End: 1-2193
atgttttccgccctgaagaagctggtggggtcggaccaggccccgggccgggacaagaacatccccgccgggctgcagtccatgaaccaggcgttgcagaggcgcttcgccaagggggtgcagtacaacatgaagatagtgatccggggagacaggaacacgggcaagacagcgctgtggcaccgcctgcagggccggccgttcgtggaggagtacatccccacacaggagatccaggtcaccagcatccactggagctacaagaccacggatgacatcgtgaaggttgaagtctgggatgtagtagacaaaggaaaatgcaaaaagcgaggcgacggcttaaagatggagaacgacccccaggaggcggagtctgaaatggccctggatgctgagttcctggacgtgtacaagaactgcaacggggtggtcatgatgttcgacattaccaagcagtggaccttcaattacattctccgggagcttccaaaagtgcccacccacgtgccagtgtgcgtgctgggaaactaccgggacatgggcgagcaccgagtcatcctgccggacgacgtgcgtgacttcatcgacaacctggacagcagacctccaggttcctcctacttccgctatgctgagtcttccatgaagaacagcttcggcctaaagtaccttcataagttcttcaatatcccatttttgcagcttcagagggagacgctgttgcggcagctggagacgaaccagctggacatggacgccacgctggaggagctgtcggtgcagcaggagacggaggaccagaactacggcatcttcctggagatgatggaggctcgcagccgtggccatgcgtccccactggcggccaacgggcagagcccatccccgggctcccagtcaccagtggtgcctgcaggcgctgtgtccacggggagctccagccccggcacaccccagcccgccccacagctgcccctcaatgccgccccaccatcctctgtgccccctgtaccaccctcagaggccctgcccccacctgcgtgcccctcagcccccgccccacggcgcagcatcatctctaggctgtttgggacgtcacctgccaccgaggcagcccctccacctccagagccagtcccggccgcagagggcccagcaacggtccagagtgtggaggactttgttcctgacgaccgcctggaccgcagcttcctggaagacacaacccccgccagggacgagaagaaggtgggggccaaggctgcccagcaggacagcgacagtgatggggaggccctgggcggcaacccgatggtggcagggttccaggacgatgtggacctcgaagaccagccacgtgggagtcccccgctgcctgcaggccccgtccccagtcaagacatcactctttcgagtgaggaggaagcagaagtggcagctcccacaaaaggccctgccccagctccccagcagtgctcagagccagagaccaagtggtcctccataccagcttcgaagccacggagggggacagctcccacgaggaccgcagcacccccctggccaggcggtgtctctgttcgcacaggtccggagaagcgcagcagcaccaggccccctgctgagatggagccggggaagggtgagcaggcctcctcgtcggagagtgaccccgagggacccattgctgcacaaatgctgtccttcgtcatggatgaccccgactttgagagcgagggatcagacacacagcgcagggcggatgactttcccgtgcgagatgacccctccgatgtgactgacgaggatgagggccctgccgagccgcccccaccccccaagctccctctccccgccttcagactgaagaatgactcggacctcttcgggctggggctggaggaggccggacccaaggagagcagtgaggaaggtaaggagggcaaaaccccctctaaggagaagaagaagaagaagaaaaaaggcaaagaggaagaagaaaaagctgccaagaagaagagcaaacacaagaagagcaaggacaaggaggagggcaaggaggagcggcgacggcggcagcagcggcccccgcgcagcagggagaggacggctgccgatgagctggaggctttcctggggggcggggccccgggcggccgccaccctgggggtggcgactacgaggagctctag

SEQ ID NO: 173016 - DNA, 3535 bp, Homo sapiens
  Payload ID: 13999
  Gene Symbol: RAB10
  Gene Name: RAB10, member RAS oncogene family
  Uniprot ID: P61026
  ENST ID: ENST00000264710
  CDS Start-End: 500-1102
gagagggcacggggaaaaggtggctctggccggggtggctcggtttcctggggctatgtaactgagctcgtcgacttaggggtccttcttcgctgccctcgccgcgtgctagcagggagtttccgctcgggagagagactgtcctcacgcccgctgcgcctcctcgacggcagagcaggcttgctcgcccgtgggagcgtcccggccgagaagccctgaggggggaggggaggccattttgtcccgaccgactccccggaaccgggcggacgggctgggagaggctgcggagccgcggtcgccgccctcggaggcactggacgccgccactgtcggggcttcctcaaagctgttcgtaggtcgcccgcgccgtctcgagcctttttcccacgcttccccggtcctccggcctgagaacgcccgagtgaggagttggccgtagtgagagggaccgatcccttggggccgccggcggcgagagcccgagccgctcctcccaatggcgaagaagacgtacgacctgcttttcaagctgctcctgatcggggattccggagtggggaagacctgcgtcctttttcgtttttcggatgatgccttcaatactacctttatttccaccataggaatagacttcaagatcaaaacagttgaattacaaggaaagaagatcaagctacagatatgggatacagcaggccaggagcgatttcacaccatcacaacctcctactacagaggcgcaatgggtatcatgctagtatatgacatcaccaatggtaaaagttttgaaaacatcagcaaatggcttagaaacatagatgagcatgccaatgaagatgtggaaagaatgttactaggaaacaagtgtgatatggacgacaaaagagttgtacctaaaggaaaaggagaacagattgcaagggagcatggtattaggttttttgagactagtgcaaaagcaaatataaacatcgaaaaggcgttcctcacgttagctgaagatatccttcgaaagacccctgtaaaagagcccaacagtgaaaatgtagatatcagcagtggaggaggcgtgacaggctggaagagcaaatgctgctgagcattctcctgttccatcagttgccatccactaccccgttttctcttcttgctgcaaaataaaccactctgtccatttttaactctaaacagatatttttgtttctcatcttaactatccaagccacctattttatttgttctttcatctgtgactgcttgctgactttatcataattttcttcaaacaaaaaaatgtatagaaaaatcatgtctgtgagttcatttttaaatgtacttgctcagctcaactgcatttcagttgtattatagtccagttcttatcaacattaaaacctatagcaatcatttcaaatctattctgcaaattgtataagaataaagttagaattaacaattttattttgtacaacagtggaattttctgtcatggataatgtgcttgagtccctataatctatagacatgtgatagcaaaagaaacaaacaaaagccaggaaaacactcattttcgccttgaatatgtaaatgggattaattttgtcctgtgccttatgtggaaaggaacttctttggttttccttttttgttctggtggaagcatgtgcaggagacatatcatccaaacataaaccattaaaatgtttgtggtttgcttggctgtaattttcaaagtagttaattgaggacaaagggtaatgcagaagtgatagctttggtttgctgagtcttgttttaagtggccttgatatttaaaactattcctgccaccatttcttctccttggccacttcttccttgcgtctccctgcatgctgctttatttgcttctccctccccaaccacctcatggtatatttaagagtgaaagggacaaactagtaggtttgtcaagtttaatataaagcactgatgtaacttgctaggtaaacggaaagataagttctaactgcctactatccaatgtcagttaattggtgtcttcccccctcatttgctctcttccctaaaatgtgtcccagatgccttcatttgctgttttacttctatgttctgcttttcctcctctctttgttcccttcctgtctatccattgagtttatgaaatggaagagttaactgcatgcactagtgtttggagggtgttgtggtttgtctttctaattaggtgtatagcctattcactttcctagaataaatctcttaacctaaatttgagtagtctgcattttggcaactcctctagcagcttggtagcctagtacaggttgtttttttaaaaaaggaaaagcaggaaggaggagtgaattttattaacatgtttgccaaatgtattgagatttggcctctgaagaacactttttcagtgttaagtttctttaccttaagattcagaaatactttagaatattattaattttaagtcctgtctttacatccttttggaaaacttgtattaccatgggtttggaaaaaggacaacgaaaggcttttcatgtaaagataagatctttagctatctctaaccctgtccttttttcactgcattttttctagttttgcttcattgcttatcattaggatagggtaagtgaagtttgctatgctgctagcatcctaagatgatacctttgttgaaagaattgtgaatagcatgattcatttctagcagaggctgagtttaggacagcagcttccattgagaagtctttctgtgtcgtgaatagcattttaatgacctcttggctcacataagcaaacaacatagggacgtatctgctatgaaaatccacaaatttttcagatagtgccctaaaaacaattttatatgcctcactggttgttattcttaggttattcccacacttgactttatcattgtttactactagtaaaaagcagcattgccaaataatccctaattttccactaaaaatataatgaaatgatgttaagctttttgaaaagtttaggttaaacctactgttgttagattaatgtatttgttgcttccctttatctggaatgtggcattagcttttttattttaaccctctttaattcttattcaattccatgacttaaggttggagagctaaacactgggatttttggataacagactgacagttttgcataattataatcggcattgtacatagaaaggatatggctaccttttgttaaatctgcactttctaaatatcaaaaaagggaaatgaagtataaatcaatttttgtataatctgtttgaaacatgagttttatttgcttaatattagggctttgccccttttctgtaagtctcttgggatcctgtgtagaagctgttctcattaaacaccaaacagttaagtccattctctggtactagctacaaattcggtttcatattctacttaacaatttaaataaactgaaatatttctagatggtctacttctgttcatataaaaacaaaacttgatttcca

SEQ ID NO: 173017 - DNA, 6253 bp, Homo sapiens
  Payload ID: 14000
  Gene Symbol: RAB11FIP1
  Gene Name: RAB11 family interacting protein 1 (class I)
  Uniprot ID: Q6WKZ4
  ENST ID: ENST00000287263
  CDS Start-End: 27-1976
ctcgcttctggagtgttatcgtcaccatgtccctaatggtctcggctggccggggcctgggggccgtgtggtccccaacccacgtgcaggtgacggtgctgcaggcgcggggcctgcgggccaagggccccgggggcacgagcgacgcgtacgcggtgatccaggtgggcaaggagaagtacgccacctccgtgtcggagcgcagcctgggcgcgcccgtgtggcgcgaggaggccaccttcgagctgccatcgctgctgtcctccggacccgcggccgccgccaccctgcagctcaccgtgctgcaccgcgcgctgctcggcctcgacaagttcctgggccgcgccgaggtggacctgcgggatctgcaccgcgaccagggccgcaggaagacgcagtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgacttcatcctgtgaagccaatgaatgcaatggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaaatcagcagaaaaaaaacaccgagacgtttctgtgacttcactttcacctgctccaggggtcaaggacttgccttgcctgataaccagccagcaggctccgaatcaccatctccctcacatgttatccggcaagagtgaattctaccaatggaagccaggttaatgattacaattaatcttttactgtacattcccaaggctttagttttaaatgccactgtgcctttaacaaggttgtaaatattttatgcccaccagagatgtggtcataagatctgatcctgagccagagattcagatggcacaggaagtattcatgtattttaacactggggttttctttctttcatactgagattttttttcagtatgtatcctccagctcttaaagcttacctgagaaagctttaaatgagaaaaggaccatgcgattggtgctgtgttacatacacatactttcttggcttctgagtagctcaggtgtggcttttggctgcagatgttaaattttgataccatgtaaacctacccagcttctcagacttgggtcttgttttttgatgggaacagaggtgtttagagaaagcctctgagtatgcctttcagattttgaacaagcggccttttctaaacatcgacttctactactctctagccttaaaataccttctgcttagatccagggcccttctactggagataggaaaagtagaattcaggaattaaaagaattactctttattcaatttgaggaacttggtgaaagcccctcctcttatgacagccaggttcctgctggctagaccagcctattcagcgctttgctaggggattgggtggtccacgcactcgctaatacagttctccaggtgtggaatgatgtcaatacgattgcttggccttttccccctgtgcctttgctcggtgctctggtttcctcagcaacactccttgtaaggggcagagacagggtccaccaactccccaagatgaagaagccccttcaggccagtcgtggtggctcatgcctgtaatcccagcactttgcaaggccgaggagggtggatcacttgaggtcaggagttcgagaccagcctgaccaacatggcgaaaccccatctctactaaaaatacaaaaattagcttggcatggtggtgcgtgcctgtaatcccagctactcgggaggctggggcaggagaattgcttgaacttgggagatggaggctgcagcgagccaagatcgtgccactgcactccagcctgggcaagagtttttttaagactcttaaaaaaagagcctgggcaatttttttaagactctgtcttaaaaaaaactaaaaagaaaaaaagaagccccttcactctacaggggacaggagaccatggattggaccccaaagggattgaactgcatctgcatgtctgtcctttgaacactttctctccctgcccaaaaggaaacccaaattatttgtgggatactggggaaattgtagtgaagggcttaatgtagttaataaaagttaaaagtcagtagaaaacaggtgcctcagccttcaaatggttgctttttttccattttccctcatgaatagactcaccagcattttacccccttgttataaaactgtgcagagcaagaagatgatacttatttttgaatttgtatttttaaaactagatttatagactttttttttttttaactagggcacttgcttccttcttagctaaaagcaccagctgagatttttcaggtaattttgttgttactcacttaagactggaattagaatgtttctggtatttctcatttttttccctggctatgatagaatctcatctaatcttgacatctctcctaggggaagaatatcacaggctaatagcgtggttgggggtgaagatgatagcagttattaaatcaggaatctcttttatgtgtgtccttgttacattgaggttaagagacaaaatcattggcagtgcaatctctttccaggatttcgtttgctgtggcattggttatatcagagcactttaatctgaaggatgatactgtaacttgatttatctaattagcttttaattatctacagctattttattttatttaattctctcctacagtactgggaccactgtaaacttctcagatgacttgtatttttgtagtgctatgaaatttatttacatacttataaagaaaactgtatgttcacttgaactctgaaaatgtacatgtatggctggacgcggtggctcacgcctgtaatcccagcactttgggaggctgaggcgggtgaatcacttgattgaggtcaggagttcgagaccagcctggccaacatggcaaaaccccgtctctactaaaaaatacagaaattagctgggtgtggtggcagacagctgtaatctcagctgctcgggaggctgaggcacaagaatcgcttgagccagggaggtggaggttgcagtgagctgagatcacatcattgcactccagcctgggcaacgggcgagactctgtctcaaaaaaaagaaagaaagaaaaggtacatgtatatatttgtcctgcattatgttttttacttgatataaatgtatttttactgtgatagtccaagtgccctggggggcaggtgtgctctatgtggttcttcttccattggagagctggcgtagagatctgcagtgttcacaaggatgttggtttggagatgtctgctgctaggacctggggtgtgtgactcagtccatatgagagggacatctgggtggaggagtaaattcctgtgctctgaaatgccacttggtagctctggacaatgaaggacaattgactcaagggtgcctggcttctgctgctgctgggaaaaaattcagtttatagcattcctgcacctcccaaagtagataacctggaggtcattcagttaacaactgtccctgaggactcagttttgggggaggggttatctgggagaagctttagcctgttctgagccattaggagacattagtgaattggagcactggagaatcctacaaatggcctatgtctcagaagagctgggacctccttccagctgctgcagatgctgacaggccctgggaggctgctgtgctctggagaagctggagcagctcatttcttggcctagcctggctgcctcagaaagagcagtcaggacttgagggaagcatcaaattctatacccataaactgcagttggaagtcagctttttgaaatgtccagcctttgcccaattgtttcagatcatctcatgcctcaggctttggcaggtatcctgccctccatcttattccagtgtgttcacctcatcaaggcagcagagtggatgaaggagtaagtctgccctttgccatactgaacagctgtggaccccgattggtgagggctctgcatatgcctgtatgaaggagatacaggtgtgtgtgcacatgccggtatgaagaagacacaggcatgtgcttctcagttttgctaacagtgggagctcaacggggcagagggaggaaggtccatgatgctcagccacatactgtagagagaggcaatttaatgttaaatgacgcaccatcctccctcccacccttctcccagtcaactttttttctttttctagaactactaattatctctcaaggctgaaaaattaattgccttaggtggagaacttaattcctagtatccaccaaacttaactccgtatctccatatggtgtctccatatctactgtgtgagctacttaactgacgccctcttcctccaactgaaggatcgcccaacgtttttggattatagaattattatttcctgctttctttctttgggacttttgaatttctttggtttcgtttttaagaagtaacccaacatttcctacaacactaaataaaatggtacttacctttcaaagatttgtgtctgtagtttggtatgggtgcaataaaaatttattttgtcttcctggaaaacctctcttggtgggggtggggggatgaccagtgtttctcatcccatgagggtctctcactgggatttctgttgctgccatcttgcctggttcccaggagtcccaaggccctttttctcaaagaggacggacatgtctggtcccttcggatgcacccttcatcttggcctgagggaccatggcactggccagagaaactgagttggaacgtgctgcccccttttcctttgcagccggtacccttggctgagcatttggacagggtctttcctc

SEQ ID NO: 173018 - DNA, 7811 bp, Homo sapiens
  Payload ID: 14000
  Gene Symbol: RAB11FIP1
  Gene Name: RAB11 family interacting protein 1 (class I)
  Uniprot ID: Q6WKZ4
  ENST ID: ENST00000330843
  CDS Start-End: 14-3865
tgttatcgtcaccatgtccctaatggtctcggctggccggggcctgggggccgtgtggtccccaacccacgtgcaggtgacggtgctgcaggcgcggggcctgcgggccaagggccccgggggcacgagcgacgcgtacgcggtgatccaggtgggcaaggagaagtacgccacctccgtgtcggagcgcagcctgggcgcgcccgtgtggcgcgaggaggccaccttcgagctgccatcgctgctgtcctccggacccgcggccgccgccaccctgcagctcaccgtgctgcaccgcgcgctgctcggcctcgacaagttcctgggccgcgccgaggtggacctgcgggatctgcaccgcgaccagggccgcaggaagacgcagtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgactggaagtgtctccagaggcgcaacccacagccaggcttccttcccctactgactccccttcctctcttcctcctcttccttctagctctggccaggcatctgtcccctctgaattgggacatggtgcagacacacagtcctctgagagtccttctgtcttctcctctctctcatctcccatagcagctcccatttccacatccactccaattgaaagctggcctctcgtagacaggggccaggccaagtctgaaggaccacccttgctccctaaggcagagttgcaaactgagagtttaacaccggttccaaattctggttcttctgccctgggatcacttttcaaacagccatcctttccagcaaataaagggacagaagattctctgatgggcaggacccgtgagacaggcacagagaagaacaccagcagccttgagttggaggagtctctcccagagcagcctgaaacagggcgacaagaggaagaacttccgagattcccctgcaaaaaacaagactacagcccatcatctggagaagcccaggaagtaccgtttgccctttcactcagcagtgatggagctgtgagccctgttggggagcttgcagcaggaggagacagagacttggagagtcaggctgggtctcttgtggagagcaaagccagggatgcagctgaagaagtggcgccccctcttcccatgggagcatcagtcccttccattgattccatgatgcggaagctggaagagatgggtctgaacctccgcaaggaccagaagaaaaccaagaagcgtgtgtcattttctgagcagctcttcacggaagaggcagtggcgggggctgccttgctggtggaaggacacagcagttgtccccaggagctgaaccctgcatggtctgttgctggaaacgcgtctgacggagagcctcctgagtctccccacgcagaggactcagaaagggaatcggtgaccacacctgggccagcgacgtgtggtgcgccagcctccccagcggatcacctcctcctcccctcccaggaggagagtttctccgaagtccccatgagtgaagcaagctcagcgaaagacactccactctttaggatggagggagaggatgcccttgtgactcagtatcagagcaaagccagtgaccacgaaggtttattgtctgaccccttgagtgaccttcagttggtctcagattttaaatctccaatcatggccgatctgaacttaagccttccttccattcctgaagtcgcatcggatgatgaaagaatagatcaggttgaagatgacggagatcaggttgaagatgatggagagacagcaaagtcgtcaactctggacataggagctttgtccttgggcttggtagtcccctgtcctgagaggggaaaggggcccagtggcgaggcagataggttggtactgggggagggcctgtgtgatttcaggctgcaagcaccccaggcatctgtgacagctccttcagagcagaccacagagttcggaattcacaaaccacatcttggcaagagctcaagcttggataaacagctgccaggccccagtggtggtgaggaagaaaaaccgatgggaaatgggagtccaagcccgcctcctggcacatccctggacaatcctgtacccagcccctccccttctgagatctttcctgtcacacactctttccccagctctgcacattctgacactcaccacaccagcacagcagaatctcaaaaaaaagccacagcagagggctccgctggtagagttgaaaattttggcaagaggaagccactcctccaggcctgggtctcaccctcggagacacatccagtctcagctcagccaggcgctggaactgggtcagccaagcacagacttcatcctgtgaagccaatgaatgcaatggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaaatcagcagaaaaaaaacaccgagacgtttctgtgacttcactttcacctgctccaggggtcaaggacttgccttgcctgataaccagccagcaggctccgaatcaccatctccctcacatgttatccggcaagagtgaattctaccaatggaagccaggttaatgattacaattaatcttttactgtacattcccaaggctttagttttaaatgccactgtgcctttaacaaggttgtaaatattttatgcccaccagagatgtggtcataagatctgatcctgagccagagattcagatggcacaggaagtattcatgtattttaacactggggttttctttctttcatactgagattttttttcagtatgtatcctccagctcttaaagcttacctgagaaagctttaaatgagaaaaggaccatgcgattggtgctgtgttacatacacatactttcttggcttctgagtagctcaggtgtggcttttggctgcagatgttaaattttgataccatgtaaacctacccagcttctcagacttgggtcttgttttttgatgggaacagaggtgtttagagaaagcctctgagtatgcctttcagattttgaacaagcggccttttctaaacatcgacttctactactctctagccttaaaataccttctgcttagatccagggcccttctactggagataggaaaagtagaattcaggaattaaaagaattactctttattcaatttgaggaacttggtgaaagcccctcctcttatgacagccaggttcctgctggctagaccagcctattcagcgctttgctaggggattgggtggtccacgcactcgctaatacagttctccaggtgtggaatgatgtcaatacgattgcttggccttttccccctgtgcctttgctcggtgctctggtttcctcagcaacactccttgtaaggggcagagacagggtccaccaactccccaagatgaagaagccccttcaggccagtcgtggtggctcatgcctgtaatcccagcactttgcaaggccgaggagggtggatcacttgaggtcaggagttcgagaccagcctgaccaacatggcgaaaccccatctctactaaaaatacaaaaattagcttggcatggtggtgcgtgcctgtaatcccagctactcgggaggctggggcaggagaattgcttgaacttgggagatggaggctgcagcgagccaagatcgtgccactgcactccagcctgggcaagagtttttttaagactcttaaaaaaagagcctgggcaatttttttaagactctgtcttaaaaaaaactaaaaagaaaaaaagaagccccttcactctacaggggacaggagaccatggattggaccccaaagggattgaactgcatctgcatgtctgtcctttgaacactttctctccctgcccaaaaggaaacccaaattatttgtgggatactggggaaattgtagtgaagggcttaatgtagttaataaaagttaaaagtcagtagaaaacaggtgcctcagccttcaaatggttgctttttttccattttccctcatgaatagactcaccagcattttacccccttgttataaaactgtgcagagcaagaagatgatacttatttttgaatttgtatttttaaaactagatttatagactttttttttttttaactagggcacttgcttccttcttagctaaaagcaccagctgagatttttcaggtaattttgttgttactcacttaagactggaattagaatgtttctggtatttctcatttttttccctggctatgatagaatctcatctaatcttgacatctctcctaggggaagaatatcacaggctaatagcgtggttgggggtgaagatgatagcagttattaaatcaggaatctcttttatgtgtgtccttgttacattgaggttaagagacaaaatcattggcagtgcaatctctttccaggatttcgtttgctgtggcattggttatatcagagcactttaatctgaaggatgatactgtaacttgatttatctaattagcttttaattatctacagctattttattttatttaattctctcctacagtactgggaccactgtaaacttctcagatgacttgtatttttgtagtgctatgaaatttatttacatacttataaagaaaactgtatgttcacttgaactctgaaaatgtacatgtatggctggacgcggtggctcacgcctgtaatcccagcactttgggaggctgaggcgggtgaatcacttgattgaggtcaggagttcgagaccagcctggccaacatggcaaaaccccgtctctactaaaaaatacagaaattagctgggtgtggtggcagacagctgtaatctcagctgctcgggaggctgaggcacaagaatcgcttgagccagggaggtggaggttgcagtgagctgagatcacatcattgcactccagcctgggcaacgggcgagactctgtctcaaaaaaaagaaagaaagaaaaggtacatgtatatatttgtcctgcattatgttttttacttgatataaatgtatttttactgtgatagtccaagtgccctggggggcaggtgtgctctatgtggttcttcttccattggagagctggcgtagagatctgcagtgttcacaaggatgttggtttggagatgtctgctgctaggacctggggtgtgtgactcagtccatatgagagggacatctgggtggaggagtaaattcctgtgctctgaaatgccacttggtagctctggacaatgaaggacaattgactcaagggtgcctggcttctgctgctgctgggaaaaaattcagtttatagcattcctgcacctcccaaagtagataacctggaggtcattcagttaacaactgtccctgaggactcagttttgggggaggggttatctgggagaagctttagcctgttctgagccattaggagacattagtgaattggagcactggagaatcctacaaatggcctatgtctcagaagagctgggacctccttccagctgctgcagatgctgacaggccctgggaggctgctgtgctctggagaagctggagcagctcatttcttggcctagcctggctgcctcagaaagagcagtcaggacttgagggaagcatcaaattctatacccataaactgcagttggaagtcagctttttgaaatgtccagcctttgcccaattgtttcagatcatctcatgcctcaggctttggcaggtatcctgccctccatcttattccagtgtgttcacctcatcaaggcagcagagtggatgaaggagtaagtctgccctttgccatactgaacagctgtggaccccgattggtgagggctctgcatatgcctgtatgaaggagatacaggtgtgtgtgcacatgccggtatgaagaagacacaggcatgtgcttctcagttttgctaacagtgggagctcaacggggcagagggaggaaggtccatgatgctcagccacatactgtagagagaggcaatttaatgttaaatgacgcaccatcctccctcccacccttctcccagtcaactttttttctttttctagaactactaattatctctcaaggctgaaaaattaattgccttaggtggagaacttaattcctagtatccaccaaacttaactccgtatctccatatggtgtctccatatctactgtgtgagctacttaactgacgccctcttcctccaactgaaggatcgcccaacgtttttggattatagaattattatttcctgctttctttctttgggacttttgaatttctttggtttcgtttttaagaagtaacccaacatttcctacaacactaaataaaatggtacttacctttcaaa

SEQ ID NO: 173019 - DNA, 1866 bp, Homo sapiens
  Payload ID: 14000
  Gene Symbol: RAB11FIP1
  Gene Name: RAB11 family interacting protein 1 (class I)
  ENST ID: ENST00000522727
  CDS Start-End: 225-1730
tgttatcgtcaccatgtccctaatggtctcggctggccggggcctgggggccgtgtggtccccaacccacgtgcaggtgacggtgctgcaggcgcggggcctgcgggccaagggccccgggggcacgagcgacgcgtacgcggtgatccaggtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgacttcatcctgtgaagccaatgaatgcaatggccaccaaggttgctaactgcagcttgggaactgccaccatcatcagtgagaacttgaacaatgaggtcatgatgaagaaatacagcccctcggaccctgcatttgcatatgcgcagctgacccacgatgagctgattcagctggtcctcaaacagaaggaaacgataagcaagaaggagttccaggtccgcgagctggaagactacattgacaacctgcttgtcagggtcatggaagaaacccccaatatcctccgcatcccgactcaggttggcaaaaaagcaggaaagatgtaaatcagcagaaaaaaaacaccgagacgtttctgtgacttcactttcacctgctccaggggtcaaggacttgccttgcctgataaccagccagcaggctccgaatcaccatctccctcacatgttatccggcaagagt

SEQ ID NO: 173020 - DNA, 1959 bp, Homo sapiens
  Payload ID: 14000
  Gene Symbol: RAB11FIP1
  Gene Name: RAB11 family interacting protein 1 (class I)
  Uniprot ID: Q6WKZ4
  ENST ID: ENST00000524118
  CDS Start-End: 640-1959
acactggatcctatctttgtctagcgcgtgtcttctcaaaaataaaagtgcaaaataaaaaacaaaacaaaagaaataaaagtgcaaattctgctctcagccgggtgcagtggctcacgcctgtaatcccaacattttgggaggctgaggcgggcggatcatctgaggtcaggagttcgagtccagcctggctaccatggtgaaaccccatctctactaaaaatacaaaaattagctggacatggtcacgcgctcctgtaatctcagctactcaggaggctgaggcaggagaatcacttgaacccaggaggcagaggctgcagtgagccgagatggtggcattgcactccagcctgggtgacagagcaagactctgtgtcaaaaaaaaaaaaaaaaaaaaaaaaaaaaattctgctctcatctaccacttcccgaagagaaagcatgagaatgcatgcattgaagaggctgctggtagcagagaggagaggccagttcatggggattgtgaacattgttgcagttgcttccattcaaaggtaactcctcagcctttctcctttcaggtggtataagttgaaatccaaaccaggaaagaaggacaaggagcgaggagaaattgaggttgacatccagtttatgagaaacaacatgactgccagcatgtttgacctttctatgaaagacaagtctcggaatccatttggaaagctgaaggacaagatcaaggggaagaataaggacagtgggtcagacaccgcctccgccatcatccctagcacgacaccttcggtcgacagtgatgatgagtctgtggttaaagacaagaaaaagaaatcaaagatcaagaccttactttccaagtcaaatttgcagaagacgcctctttcccagtccatgtctgtcctgccgacttcaaagccagaaaaagtgctgcttcgtcccggagactttcagtcccagtgggatgaagatgacaatgaggatgagtcctcctcggcctcggatgtcatgtctcacaagagaacagcgagtacggatcttaagcaactgaaccaggtcaactttacccttcccaagaaggaaggactttcctttcttggtggccttcggtctaagaatgatgtcctttcccgctctaatgtctgcatcaatgggaaccatgtttacctggagcagccagaagccaagggtgagatcaaggatagcagcccgtcctcctccccatcccccaagggcttcagaaagaagcatttgttctcttctacagagaacctggcggctgggtcttggaaggagcctgctgaaggaggtgggctgtcttctgacaggcagctctccgaatcttccaccaaggactccttgaagtctatgaccctgccgtcctaccgacctgccccactggtcagtggggacctcagggaaaacatggcccccgcaaactcagaggccacaaaagaagctaaggagagcaagaagccagagagcaggaggtcctctttgctgtctctgatgacggggaagaaggatgtggctaagggcagtgaaggtgaaaaccctctcacggtcccagggagggagaaggaaggcatgctgatgggggttaagccgggggaggacgcatcggggcctgctgaagaccttgtgagaagatctgagaaagatactgcagctgttgtctccagacagggcagctccctgaacctctttgaagatgtgcagatcacagaaccagaagctgagccagagtccaagtctgaaccgagacctccaatttcctctccgagggctccccagaccagagctgtcaagccccgacttcatcctgtgaagccaatgaatgcaatggccaccaaggttgctaactgcagcttgggaactgccaccatcatcagtgagaacttgaacaatgaggtcatgatgaaggtatgtcctctgagaagctggtgtgttcgttag

SEQ ID NO: 173021 - DNA, 6061 bp, Homo sapiens
  Payload ID: 14001
  Gene Symbol: RAB11FIP2
  Gene Name: RAB11 family interacting protein 2 (class I)
  Uniprot ID: Q7L804
  ENST ID: ENST00000355624
  CDS Start-End: 441-1979
gggcgggcgggaggcgcggaggcagcggaggctgctcggccgcaaggaggcaggcgggaggccaggggtgcagaattggggcgggggctcccttcacccccgcagccctccgcccgggtccgtgtggccaggcctcacgtgccccgcaggcctggggaaggtggagacaggggcgggggtccgcgcagaggcctgcacggcgcggccaggtgatggtgggcctctgtgtttctccagacgaaaggggacccccggagcggccgtgcccctgggctgcccccgcgaggcgttttgacatcagccatagggaagtcggggagccctgagcctgcctgtttccgttaagtgtccttaggatgcagtgattaaggaattaggctctccctccgggaggggcactgcctgtgctagggaactcgggggcagagaaacaggacaggatgatgctgtccgagcaagcccaaaagtggtttccaacccacgtgcaggtcacagtgctccaagccaaagatctgaagccaaaaggcaaaagtggtaccaatgacacatacactataattcagctgggcaaggaaaagtactccacctctgtagctgagaaaacccttgagccagtttggaaggaggaggcctctttcgagctacctggattgctaattcagggaagtccagagaaatacattcttttccttatagttatgcacaggtccctggtgggtctggataaatttttagggcaggtggcaatcaatctcaatgacatctttgaggacaaacaaagaaggaaaacagagtggtttagattagaatccaaacaaggaaaacgaatcaaaaacaggggtgagataaaggtcaatattcagtttatgaggaacaatatgaccgcaagtatgtttgacttatcaatgaaggacaaaaccagatctccttttgcaaagttaaaagataagatgaagggtagaaaaaatgatggaacattttctgatacgtcttctgcaatcattccaagtactcacatgcccgatgccaatagtgaattttcaagtggtgaaatacagatgaaatccaaaccaaaaaagccttttctcttgggtcctcagcgactctcgtcagcgcattcaatgtctgatttatctgggtcccatatgtcttctgagaaactgaaggctggcaccataggtcaaacacatcttctcggacaccagttagattcctttggaacagttccagaaagtggaagtctcaaatctccacacagaagaacattaagctttgatacttctaaaatgaaccaacctgacagcattgtggatgaaggtgaattgtgtttcggaagacaaaatgacccatttacaaatgtgactgcttcattaccccaaaaatttgcaacactgccaaggaagaaaaatccatttgaagaaagcagcgaaacatgggacagcagcatgaatttattttcaaaaccaattgaaataagaaaagaaaataaaagagagaaaagggagaaagttagcctgtttgaaagagtgactggaaaaaaagatagcagaagatctgataaacttaacaatgggggatctgatagcccttgtgacttgaaatcacctaatgcatttagtgaaaatcgccaggactattttgattatgagtcaaccaatccatttacagcaaaattcagggcttcaaatataatgccatcttcaagttttcatatgagtccaacaagcaatgaagacctcaggaaaatcccggacagcaacccctttgatgccactgcagggtatcgtagtctgacctatgaagaggttctacaggagctggtgaaacacaaagaactccttaggaggaaagacacccacatccgggaactcgaggactacatcgacaacctccttgtaagggtaatggaagaaacgcccagtattctcagagtgccgtatgaaccatccaggaaagctggcaaattctctaacagttaataaagccaattgtattgtattgataattggacaaagagagagaaagaaagaaggaaggaaggaaaaacttgttactgaaagagactacactatcaggtttcattacatattctcctttattgtgaagagtagttttacctgtaaatattagcagggactatcaagagtgacctttgaagcaagctaaatcatttaaatgtttaaattgaaaatgggccagattctcaatgaataagtggttccttaggactcactcaggtgctggtactgacccactaatctgccataggcccagaaatatcttcagaagtacgtgagttgttcctcaggaatagatttttcataaagcagaattgatcctgtggctggtttctcagaaatcagtttgtagaaatatttagcttcaggaatactgctcgttataaacactactaaaaaaacagtttatattttatatacacatatgtacatgaatatatatatattcatgtatcttgtatataaaatataggcatatacctcatatatacatgtgtttttagaacatttagaaacaattgattgcctctaaagttaggctaccaatttcttgatttgaaaatgtgtgtgctctattgatgcaagacaagtcatccttcctactgtcatggtttgttatagagaagctgcttcaaatcactcttgactacatggaccttggtttcaaagtgagctgctatatattattctagcatcaaagtttttctctttccccaaaagtgatgatctcaagtccttttttaaagaatgacaaattttaggagacttcattaacttcataacagcatgaatttatttgaattaattaacatttgagtttgtttaaggtataagcagaagataagctaatatagcttgttttgttgaaattctgcatgcctttaaatcactagcaaagcaaatattataaagttatatctgaaaataattgtgggaagtatgtgattgcctggtgtgtctgataacccaaagcagcgggcagattccaggaatgaagaattaggcttggtttcaggttacataaataatagagcagatggttgcctttgggtcttgaaccaaaataagacttactaaaggaagagtgagtttttagaagagaactttacgagcgtgacattatgcattactccacatccaccctttaagaattgatttattacaaaattatgttctattttaaagtccactcccccaaaatactgatttcttccatggattatttttatatgatttgtacaaattttttctgaaatttaaattgacaagcaatgttataaaaatattgctaatcttctgcttatttttcagcctttaaagtctgaaatactataaaacactgagagtatctatgtctttctgaatttaaaatgaaaattcatgtccatatggagacttacatattccccaatctttccatgaattgcatttttttctaatacttatctctgttaagactccattgaaagttaaacaaaaagccgatataatagtttgggttttttttttttgcttattttagtattttgaatcagagaatacttggccaagctcgtatttgtaaactaaaaccccttgttatttgtatcttctgcatttcagttttactgtaagaacatacattttgaaattatgaacatttttttcataaaaattaaatgctttaagaaatggagaaggaaaaatagcttttatcaatttttttctcctcaagattctgtaataaacctcaaagtctggtgtagaatggtattttcccgtttgaggtcttggtagttttttttttttttttaaacatggtgccacttttaattaactaaatgttacaaaattctcagcatttgtttttgtctggtagtattattgagtcttttcatacacttcttaaaatgtgaaaatctatgttttcagtattatgacagtatctgcagatactataataatatgctttggccaaatttgctgtttatagagtgaaccaagatgtcagttttgtattggggatatgttttacataaatagaactcatttaaaagtatggttcaagtactgctcttctttttatggggaaattgatttttaaggagcgattcttttcctatataaaagctattgaggcttagctttattcatacatgagtgatttggttataactcaatcaaaatttttatctttaaatctgagacaagtattatatttaaaactagatctattaatacattcatcactgcctgaaaatttgctgttctaatgtttgtgaattttcactcattacctagagtaaacttattgcatattttcataatcagtcaaaataataaaactaaaaacaaaaagtaaaaattagttcccaagtaaatatatcagtgtttcctgtgtttgggcagaagtgcaaagtagttttaatttctcacgttgtagaaaaagaggccaaaaaggtcaccttagtttatttttccaaaacataactttaggtattctaatgtattttgttagttgcttagaaatggaaataaaatatatgtgcttattaaataatgcacagtacactagattatagagtttatttttgcttttatgctttaaagaatgcatgcccaaaacactactaccaacaagaggattttttaaaatcacagaattgatatttatctcaagactatcttaagctaatgtacttctgttacataattaaactatttctgctattatttttaaagcagtattattttataaccaattctaaaattcagctttaaaaatattgaacataccttcctaccacttacgcttcaagtttcatttattgaataccagggtcatatcttagaattgtatataaaacaacatgtaacccattcatgaaaaacgtttttaagtattgctttttgctgctatgttctgcattgagcctagttttgccattgtcccctgaatgtagtattatctatagattatacataactacatctattgcttttggtggtaaatcaagatttagttgtaattttccagctgtgaaaatgttgccttgtatttaaaagggtttcatgaatggaaacctaagtaaaactaagctcattagtgacagacttgttttcttcttgttattcctccagcaactccctcaccaccacgcctccctgcctaccatccccggaagggtgcttattctttaacaaagagaatctaaaaaaaaaaacaaaaaactgttgtctaatatatctacagtaaatgttacactagagcttttattttcctctgtagcttttcagaagaagcaatttaccttggatttgtaaatcaagctgaaacttttttgatgttcatgtactcatatgtcttgtaggtggtaggtgtcacttgtgtgtatgtgtaagtgaagtatgatgcatgctcattcacttggtccctttgaaataagggaaaggatcacagtgctgctgggccatgatggtatgtagaagggtctgtcagcacacatggaaagcccccatttgcacagatgtagaactttaataatccagatgcaatcattggaagtatttaatatgcaattggtagcaccttagctaattaatctgcatatgaagcattttctgatatatttaataagaggtatagaagctcttcaagcattaaaatagagttgatgtttcattccatttgttttatccatcaaaaaatgcactctcacagtggagttgaagtctaatacatgatacatgtgggcctgttagtcttcgaagcttccagatggtttgtgttttgaggtacaaaaaaatgctgcagatctagaaatgcatatatttagcgggtatttgaaagatagaagcattatttataactgaagagtataacacttatcttcttaagtaaatgctctcataacttgtatacatttttgcaggtacaaattcaaaagtatgtaagcattgtataatgtgacaattgtataatttatgtaatctgatgcatgaatcagaatttttatataatatatgattattgacttatagttgattaaagtgtttaaacttaa

SEQ ID NO: 173022 - DNA, 6119 bp, Homo sapiens
  Payload ID: 14001
  Gene Symbol: RAB11FIP2
  Gene Name: RAB11 family interacting protein 2 (class I)
  Uniprot ID: Q7L804
  ENST ID: ENST00000369199
  CDS Start-End: 441-2039
gggcgggcgggaggcgcggaggcagcggaggctgctcggccgcaaggaggcaggcgggaggccaggggtgcagaattggggcgggggctcccttcacccccgcagccctccgcccgggtccgtgtggccaggcctcacgtgccccgcaggcctggggaaggtggagacaggggcgggggtccgcgcagaggcctgcacggcgcggccaggtgatggtgggcctctgtgtttctccagacgaaaggggacccccggagcggccgtgcccctgggctgcccccgcgaggcgttttgacatcagccatagggaagtcggggagccctgagcctgcctgtttccgttaagtgtccttaggatgcagtgattaaggaattaggctctccctccgggaggggcactgcctgtgctagggaactcgggggcagagaaacaggacaggatgatgctgtccgagcaagcccaaaagtggtttccaacccacgtgcaggtcacagtgctccaagccaaagatctgaagccaaaaggcaaaagtggtaccaatgacacatacactataattcagctgggcaaggaaaagtactccacctctgtagctgagaaaacccttgagccagtttggaaggaggaggcctctttcgagctacctggattgctaattcagggaagtccagagaaatacattcttttccttatagttatgcacaggtccctggtgggtctggataaatttttagggcaggtggcaatcaatctcaatgacatctttgaggacaaacaaagaaggaaaacagagtggtttagattagaatccaaacaaggaaaacgaatcaaaaacaggggtgagataaaggtcaatattcagtttatgaggaacaatatgaccgcaagtatgtttgacttatcaatgaaggacaaaaccagatctccttttgcaaagttaaaagataagatgaagggtagaaaaaatgatggaacattttctgatacgtcttctgcaatcattccaagtactcacatgcccgatgccaatagtgaattttcaagtggtgaaatacagatgaaatccaaaccaaaaaagccttttctcttgggtcctcagcgactctcgtcagcgcattcaatgtctgatttatctgggtcccatatgtcttctgagaaactgaaggctggcaccataggtcaaacacatcttctcggacaccagttagattcctttggaacagttccagaaagtggaagtctcaaatctccacacagaagaacattaagctttgatacttctaaaatgaaccaacctgacagcattgtggatgaaggtgaattgtgtttcggaagacaaaatgacccatttacaaatgtgactgcttcattaccccaaaaatttgcaacactgccaaggaagaaaaatccatttgaagaaagcagcgaaacatgggacagcagcatgaatttattttcaaaaccaattgaaataagaaaagaaaataaaagagagaaaagggagaaagttagcctgtttgaaagagtgactggaaaaaaagatagcagaagatctgataaacttaacaatgggggatctgatagcccttgtgacttgaaatcacctaatgcatttagtgaaaatcgccaggactattttgattatgagtcaaccaatccatttacagcaaaattcagggcttcaaatataatgccatcttcaagaaatactttgctgacccctgcagtagctgaatggagaggatctttgagatgggcagagctttttcatatgagtccaacaagcaatgaagacctcaggaaaatcccggacagcaacccctttgatgccactgcagggtatcgtagtctgacctatgaagaggttctacaggagctggtgaaacacaaagaactccttaggaggaaagacacccacatccgggaactcgaggactacatcgacaacctccttgtaagggtaatggaagaaacgcccagtattctcagagtgccgtatgaaccatccaggaaagctggcaaattctctaacagttaataaagccaattgtattgtattgataattggacaaagagagagaaagaaagaaggaaggaaggaaaaacttgttactgaaagagactacactatcaggtttcattacatattctcctttattgtgaagagtagttttacctgtaaatattagcagggactatcaagagtgacctttgaagcaagctaaatcatttaaatgtttaaattgaaaatgggccagattctcaatgaataagtggttccttaggactcactcaggtgctggtactgacccactaatctgccataggcccagaaatatcttcagaagtacgtgagttgttcctcaggaatagatttttcataaagcagaattgatcctgtggctggtttctcagaaatcagtttgtagaaatatttagcttcaggaatactgctcgttataaacactactaaaaaaacagtttatattttatatacacatatgtacatgaatatatatatattcatgtatcttgtatataaaatataggcatatacctcatatatacatgtgtttttagaacatttagaaacaattgattgcctctaaagttaggctaccaatttcttgatttgaaaatgtgtgtgctctattgatgcaagacaagtcatccttcctactgtcatggtttgttatagagaagctgcttcaaatcactcttgactacatggaccttggtttcaaagtgagctgctatatattattctagcatcaaagtttttctctttccccaaaagtgatgatctcaagtccttttttaaagaatgacaaattttaggagacttcattaacttcataacagcatgaatttatttgaattaattaacatttgagtttgtttaaggtataagcagaagataagctaatatagcttgttttgttgaaattctgcatgcctttaaatcactagcaaagcaaatattataaagttatatctgaaaataattgtgggaagtatgtgattgcctggtgtgtctgataacccaaagcagcgggcagattccaggaatgaagaattaggcttggtttcaggttacataaataatagagcagatggttgcctttgggtcttgaaccaaaataagacttactaaaggaagagtgagtttttagaagagaactttacgagcgtgacattatgcattactccacatccaccctttaagaattgatttattacaaaattatgttctattttaaagtccactcccccaaaatactgatttcttccatggattatttttatatgatttgtacaaattttttctgaaatttaaattgacaagcaatgttataaaaatattgctaatcttctgcttatttttcagcctttaaagtctgaaatactataaaacactgagagtatctatgtctttctgaatttaaaatgaaaattcatgtccatatggagacttacatattccccaatctttccatgaattgcatttttttctaatacttatctctgttaagactccattgaaagttaaacaaaaagccgatataatagtttgggttttttttttttgcttattttagtattttgaatcagagaatacttggccaagctcgtatttgtaaactaaaaccccttgttatttgtatcttctgcatttcagttttactgtaagaacatacattttgaaattatgaacatttttttcataaaaattaaatgctttaagaaatggagaaggaaaaatagcttttatcaatttttttctcctcaagattctgtaataaacctcaaagtctggtgtagaatggtattttcccgtttgaggtcttggtagttttttttttttttttaaacatggtgccacttttaattaactaaatgttacaaaattctcagcatttgtttttgtctggtagtattattgagtcttttcatacacttcttaaaatgtgaaaatctatgttttcagtattatgacagtatctgcagatactataataatatgctttggccaaatttgctgtttatagagtgaaccaagatgtcagttttgtattggggatatgttttacataaatagaactcatttaaaagtatggttcaagtactgctcttctttttatggggaaattgatttttaaggagcgattcttttcctatataaaagctattgaggcttagctttattcatacatgagtgatttggttataactcaatcaaaatttttatctttaaatctgagacaagtattatatttaaaactagatctattaatacattcatcactgcctgaaaatttgctgttctaatgtttgtgaattttcactcattacctagagtaaacttattgcatattttcataatcagtcaaaataataaaactaaaaacaaaaagtaaaaattagttcccaagtaaatatatcagtgtttcctgtgtttgggcagaagtgcaaagtagttttaatttctcacgttgtagaaaaagaggccaaaaaggtcaccttagtttatttttccaaaacataactttaggtattctaatgtattttgttagttgcttagaaatggaaataaaatatatgtgcttattaaataatgcacagtacactagattatagagtttatttttgcttttatgctttaaagaatgcatgcccaaaacactactaccaacaagaggattttttaaaatcacagaattgatatttatctcaagactatcttaagctaatgtacttctgttacataattaaactatttctgctattatttttaaagcagtattattttataaccaattctaaaattcagctttaaaaatattgaacataccttcctaccacttacgcttcaagtttcatttattgaataccagggtcatatcttagaattgtatataaaacaacatgtaacccattcatgaaaaacgtttttaagtattgctttttgctgctatgttctgcattgagcctagttttgccattgtcccctgaatgtagtattatctatagattatacataactacatctattgcttttggtggtaaatcaagatttagttgtaattttccagctgtgaaaatgttgccttgtatttaaaagggtttcatgaatggaaacctaagtaaaactaagctcattagtgacagacttgttttcttcttgttattcctccagcaactccctcaccaccacgcctccctgcctaccatccccggaagggtgcttattctttaacaaagagaatctaaaaaaaaaaacaaaaaactgttgtctaatatatctacagtaaatgttacactagagcttttattttcctctgtagcttttcagaagaagcaatttaccttggatttgtaaatcaagctgaaacttttttgatgttcatgtactcatatgtcttgtaggtggtaggtgtcacttgtgtgtatgtgtaagtgaagtatgatgcatgctcattcacttggtccctttgaaataagggaaaggatcacagtgctgctgggccatgatggtatgtagaagggtctgtcagcacacatggaaagcccccatttgcacagatgtagaactttaataatccagatgcaatcattggaagtatttaatatgcaattggtagcaccttagctaattaatctgcatatgaagcattttctgatatatttaataagaggtatagaagctcttcaagcattaaaatagagttgatgtttcattccatttgttttatccatcaaaaaatgcactctcacagtggagttgaagtctaatacatgatacatgtgggcctgttagtcttcgaagcttccagatggtttgtgttttgaggtacaaaaaaatgctgcagatctagaaatgcatatatttagcgggtatttgaaagatagaagcattatttataactgaagagtataacacttatcttcttaagtaaatgctctcataacttgtatacatttttgcaggtacaaattcaaaagtatgtaagcattgtataatgtgacaattgtataatttatgtaatctgatgcatgaatcagaatttttatataatatatgattattgacttatagttgattaaagtgtttaaactt

SEQ ID NO: 173023 - DNA, 4831 bp, Homo sapiens
  Payload ID: 14002
  Gene Symbol: RAB11FIP3
  Gene Name: RAB11 family interacting protein 3 (class II)
  Uniprot ID: O75154
  ENST ID: ENST00000262305
  CDS Start-End: 389-2659
cgttagttctccgggtacctcaggcgcctcagcctccttagtctcctcatcctgcttcacaggctccgcggcctccggcctcctcggcccccgtcccccggcctcctcggcccccgtcccccgccatccgccgcccggatcctcgccgccctccctaggccgccccgccgccatgggcctgcgcccgccgcgccgccgggccgagggcagctgaggcgcggtgcgaagatgggcgaggacagagcagggcccgagcgccagccccagcagcccgggcgccccgcgcgcgcccgcccgcgccgccgaggggatgcccgcgcccgccgccgcgccctgagcgcctttgtctgccgcccgcgcccttccgcaccactagcctctcgggagcatggcgtcggccccgccggcctcgcccccgggctcggagccgccggggcccgacccggagccgggcgggccggacgggccgggggcggcacaactggctccgggccctgcggagctacgcctcggagcgcccgtcggcggccccgacccgcagtccccgggcctggatgagcctgcgcccggggccgctgcagatggcggggcgcgttggagcgccgggccggccccggggctggagggaggcccgcgagaccccgggccgtccgccccgccgccgcgctccggcccgcgggggcagcttgcgagccccgacgccccgggcccagggccgcgctccgaagcgccgcttccagaactcgacccgttgttctcctggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtgaaggacttaactaagtacttggatcccagtgggctcggcgtgatcagctttgaagacttctaccaagggatcacagccatcagaaacggagatcctgatggccagtgctacggtggtgtcgcttctgcccaagatgaggagcccctggcctgcccggacgagttcgatgacttcgtcacctatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcaggagaacctgcagctggtgcacagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggctacagcaactggacgaggagaacagtgaactccggtcctgcacgccctgtctgaaggccaacattgagcgtctggaggaggagaagcagaagctgttggatgagatagagtcgctgacgctgcggctcagtgaagagcaggagaacaagaggagaatgggggacaggctgagtcacgagaggcaccagttccagagggacaaggaggccacccaggagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggacaaccgcaacctgaaggagcagaacgaggagctgaacgggcagatcattaccctcagcatccagggcgccaagagcctcttctccacagccttctctgagtccctggctgcagagatcagctccgtctcccgagatgagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatatatatatgtataatatataaagactggcaccctgcctctctgtgcccaggcccagccctggtgacatggcaccactcagcagtgctgtcactgtaagcatggactcccaggagacagtgtgggaaacgctcctgctttaattccccgagaaacggctcttcctgcctggatgcaggagggcaggggccaccacagattaaagctgttactgcacacgcagaggccggcttcttcctccaggggggccacagggtggggtgggagtcttctgggcctggcccagcttccctcaaggcgtccgaggccatcagttgtctgagctcagaacccagcagacctgcctggctctgcagcttggtcagactaagacccttccaaggccgtaggattgcacctccaggcccagtggagcctggcagctttccagccaggttctggatcctgacgagctgctgagacagcatcaaggtggggcaggtggggcggggcaaattgggcagcacagggctgtgtgggcatcagggctctgggtcacacgcctctggggacgtacgtcccatgtcgggagagccgtcaaaacgtccccgggattaagagaagagtggggggcagggcgcagaggctcacgccataatctcagcactttgggaggccaaggcaggaggatcgcttgaacccgggagttcaagaccagcctgggcaacatagcaaggccccatctctaaaaaataaaaaattaaccagg

SEQ ID NO: 173024 - DNA, 804 bp, Homo sapiens
  Payload ID: 14002
  Gene Symbol: RAB11FIP3
  Gene Name: RAB11 family interacting protein 3 (class II)
  ENST ID: ENST00000452814
  CDS Start-End: 258-804
caggttaaactttctcctaggtggtgatgtgcctccaggtgagcgcacaggctttgcagaaaccccagcatgacaagcaagtaggaaggtgacattgttgtttgagaaaagccagtgacccggttgggacggagacacgatggggagccggtctccaacagcatgcccttcctgaaggtgtgtacagagccaggcccagcctgtgaggccacccgggccagcatctgagggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcagg

SEQ ID NO: 173025 - DNA, 3550 bp, Homo sapiens
  Payload ID: 14002
  Gene Symbol: RAB11FIP3
  Gene Name: RAB11 family interacting protein 3 (class II)
  ENST ID: ENST00000434585
  CDS Start-End: 1-2034
tggactgaggagcccgaggagtgtggccccgcgagctgcccggagagcgcgcctttccgcttgcaggggtccagcagcagccaccgagcgcggggcgaggtcgacgtcttctctcccttccccgcgcccacggcgggcgagctggcgctggagcaaggtcccgggtccccgccgcagccctcggacctcagccagacccacccccttccgagcgagcccgtggggagtcaggaggacggcccccgcctccgagccgtgttcgatgccctggacggggatggggacggtttcgtccgcatcgaggacttcatccagtttgctacggtctacggggcagagcaggtgaaggacttaactaagtacttggatcccagtgggctcggcgtgatcagctttgaagacttctaccaagggatcacagccatcagaaacggagatcctgatggccagtgctacggtggtgtcgcttctgcccaagatgaggagcccctggcctgcccggacgagttcgatgacttcgtcacctatgaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagcactgaccctcttgccgcaaagctgcacagcatcctcactgatgaggcgtttgagttttactgtagccagtgccacaaacaaatcaaccgccttgaggatctttctgcccgcctgagtgatcttgaaatgaatagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcaggagaacctgcagctggtgcacagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggctacagcaactggacgaggagaacagtgaactccggtcctgcacgccctgtctgaaggccaacattgagcgtctggaggaggagaagcagaagctgttggatgagatagagtcgctgacgctgcggctcagtgaagagcaggagaacaagaggagaatgggggacaggctgagtcacgagaggcaccagttccagagggacaaggaggccacccaggagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggacaaccgcaacctgaaggagcagaacgaggagctgaacgggcagatcattaccctcagcatccagggcgccaagagcctcttctccacagccttctctgagtccctggctgcagagatcagctccgtctcccgagatgagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatatatatatgtataatatataaagactggcaccctgcctctctgtgcccaggcccagccctggtgacatggcaccactcagcagtgctgtc

SEQ ID NO: 173026 - DNA, 580 bp, Homo sapiens
  Payload ID: 14002
  Gene Symbol: RAB11FIP3
  Gene Name: RAB11 family interacting protein 3 (class II)
  ENST ID: ENST00000449879
  CDS Start-End: 108-580
gcagaaaccccagcatgacaagcaagtaggaaggtgacattgttgtttgagaaaagccagtgacccggttgggacggagacacgatggggagccggtctccaacagcatgcccttcctgaaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagtccgacaaagcggctctccagcaagaaggtggcaaggtacctgcaccagtcaggggccctgaccatggaggccctggaggacccttcccccgagct

SEQ ID NO: 173027 - DNA, 558 bp, Homo sapiens
  Payload ID: 14002
  Gene Symbol: RAB11FIP3
  Gene Name: RAB11 family interacting protein 3 (class II)
  ENST ID: ENST00000412256
  CDS Start-End: 1-411
ggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagcactgaccctcttgccgcaaagctgcacagcatcctcactgatgaggcgtttgagttttactgtagccagtgccacaaacaaatcaaccgccttgaggatctttctgcccgcctgagtgatcttgaaatgaatagtccgacaaagcggctctccagcaagaaggtggcaagcttcgtatagatctgttggcttcctgctgtgaaagatggcaacatacacttttatcttcctcccctgccagttcttaccgaaataaacatgcagggttaaggcccttcccagggagccactcagtgtggctgccgggtggcctctgctgccgtcaga

SEQ ID NO: 173028 - DNA, 3203 bp, Homo sapiens
  Payload ID: 14002
  Gene Symbol: RAB11FIP3
  Gene Name: RAB11 family interacting protein 3 (class II)
  Uniprot ID: O75154
  ENST ID: ENST00000450428
  CDS Start-End: 182-1564
attagagcgtgtctgggagcaggttaaactttctcctaggtggtgatgtgcctccaggtgagcgcacaggctttgcagaaaccccagcatgacaagcaagtaggaaggtgacattgttgtttgagaaaagccagtgacccggttgggacggagacacgatggggagccggtctccaacagcatgcccttcctgaaggccaacgaggtgacggacagcgcgtacatgggctccgagagcacctacagtgagtgtgagaccttcacggacgaggacaccagcaccctggtgcaccctgagctgcaacctgaaggggacgcagacagtgccggcggctcggccgtgccctctgagtgcctggacgccatggaggagcccgaccatggtgccctgctgctgctcccaggcaggcctcacccccatggccagtctgtcatcacggtgatcgggggcgaggagcactttgaggactacggtgaaggcagtgaggcggagctgtccccagagaccctatgcaacgggcagctgggctgcagtgaccccgctttcctcacgcccagtccgacaaagcggctctccagcaagaaggtggcaaggtacctgcaccagtcaggggccctgaccatggaggccctggaggacccttcccccgagctcatggagggcccagaggaggacattgctgacaaggttgtcttcctggaaaggcgtgtgctggagctggaaaaggacacggcagccaccggtgagcaacacagccgcctgaggcaggagaacctgcagctggtgcacagagcaaacgccctggaggagcagctgaaggagcaggagctgagagcctgcgagatggtcctggaagagacccggcgtcagaaggagctcctgtgcaagatggagagggagaagagcattgagatcgagaacctgcagaccaggctacagcaactggacgaggagaacagtgaactccggtcctgcacgccctgtctgaaggccaacattgagcgtctggaggaggagaagcagaagctgttggatgagatagagtcgctgacgctgcggctcagtgaagagcaggagaacaagaggagaatgggggacaggctgagtcacgagaggcaccagttccagagggacaaggaggccacccaggagctgatcgaggacctccgaaagcagctggagcacctgcagctcctcaagctggaggccgagcagcggcggggccgcagcagcagcatgggcctgcaggagtaccacagccgcgcccgggagagcgagctggagcaggaggtccgcaggctgaagcaggacaaccgcaacctgaaggagcagaacgaggagctgaacgggcagatcattaccctcagcatccagggcgccaagagcctcttctccacagccttctctgagtccctggctgcagagatcagctccgtctcccgagatgagctcatggaggcgattcagaagcaggaggagatcaacttccgcctgcaggactacatcgacaggatcatcgtggccatcatggagaccaacccgtccatcctggaggtcaagtagaggcaggaaggtccagcctgagctggattcgggactccaacaccctggagtggttccgtcagaccatgaggagccaagaccagcaggtcccacagccgacagtgcccagagcatgcagggaaccctcgtgcagctgagctggggccgccaaagaccggggctgccaaaggggcagagggtggtggagaggagagggagaaagggaagtcccagggcccggggtccacagaggatgagggttgtggcagggccgtccatcagcgctgaccttccgggggcccagagcttcccagccctgagtcaagctggccatgaacgcgtacacttcagttcagcaggatgggctggagagcctctctgtgcagcggtgtggggtgagccctgctgtggcctccttgtggtggtccctcttcccacgtgcagccctgttgggaagaaaggaagaaaacaggtccctccaggggtgctgctgcctaagccacccacataagtacgctggtgccgtgtcacccatgttgagccgctcctgatggctgacgggctcccagaccctcacctcggacatggtggtgggggaaggacgggtgggcaaggctggtgcgttccccagctctccctacgctgctcgggccattgcccagccagatgtggtcacctcagtccagctctggggcctccaggccatgtggctgttcccacggcccagtcctcgctgcagtaacccctgggggctctgaccacctatgggggccgggcaggagcctctggggcctccactccgacatcaggacctgagatgaccgctgtgtggcgctctctccctgggcagggtggatgccacaggcccctctggctcccaggtgctgcttctccacaggtgcggcctggcccggcctcctaaaggccacaccctccccacgcacttcccaggccagaatccaaacatcgggaaccctgttttcttctgggtgtgtctcacttagaaatcgtggttcttccccgagggtgcatgttgcaggagggagagggcagggaagactcacagcagagcaggagggggcctgtgcttctcggggtctgcaccccaggcacagcggtgtcaccccgcaggaccgcgggcctgccccaacccccagcattcccgggtgggcccagaccccatcaccaagactggccacccgctgcgtgtgtgtgcgcgcgcgtgtacgtgtggccccacatccgccgccttccacgctaggatgtaagaggtcgcctcctattgtacatttggggaaagccttgggtgtaaatcagtgtaaacttggaggagagatttttctatcatgtagagtaggtattttttatagattgaaggttgatcaattttttaatactttcaagagaaaactgtgtatacacatgaaatatatatatatatatatatatatatatgtataatatataaagactggcaccctgcctctctgtgcccaggcccagccctggtgacatggcaccactcagcagtgctgtcactgtaagcatggactcccaggagacagtgtgggaaacgctcctgctttaattccccgagaaacggctcttcctgcctggatgcaggagggcaggggccaccacagattaaagctgttactgc

SEQ ID NO: 173029 - DNA, 4831 bp, Homo sapiens; identical to SEQ ID NO: 173023
  Payload ID: 14002
  Gene Symbol: RAB11FIP3
  Gene Name: RAB11 family interacting protein 3 (class II)
  Uniprot ID: O75154
  ENST ID: ENST00000611004
  CDS Start-End: 389-2659

SEQ ID NO: 173030 - DNA, 3203 bp, Homo sapiens; identical to SEQ ID NO: 173028
  Payload ID: 14002
  Gene Symbol: RAB11FIP3
  Gene Name: RAB11 family interacting protein 3 (class II)
  Uniprot ID: O75154
  ENST ID: ENST00000610934
  CDS Start-End: 182-1564

SEQ ID NO: 173031 - DNA, 580 bp, Homo sapiens; identical to SEQ ID NO: 173026
  Payload ID: 14002
  Gene Symbol: RAB11FIP3
  Gene Name: RAB11 family interacting protein 3 (class II)
  ENST ID: ENST00000632539
  CDS Start-End: 108-580

SEQ ID NO: 173032 - DNA, 3550 bp, Homo sapiens; identical to SEQ ID NO: 173025
  Payload ID: 14002
  Gene Symbol: RAB11FIP3
  Gene Name: RAB11 family interacting protein 3 (class II)
  ENST ID: ENST00000633920
  CDS Start-End: 1-2034

SEQ ID NO: 173033 - DNA, 558 bp, Homo sapiens; identical to SEQ ID NO: 173027
  Payload ID: 14002
  Gene Symbol: RAB11FIP3
  Gene Name: RAB11 family interacting protein 3 (class II)
  ENST ID: ENST00000633334
  CDS Start-End: 1-411

SEQ ID NO: 173034 - DNA, 804 bp, Homo sapiens; identical to SEQ ID NO: 173024
  Payload ID: 14002
  Gene Symbol: RAB11FIP3
  Gene Name: RAB11 family interacting protein 3 (class II)
  ENST ID: ENST00000631977
  CDS Start-End: 258-804

SEQ ID NO: 173035 - DNA, 1968 bp, Homo sapiens
  Payload ID: 14003
  Gene Symbol: RAB11FIP4
  Gene Name: RAB11 family interacting protein 4 (class II)
  Uniprot ID: Q86YS3
  ENST ID: ENST00000394744
  CDS Start-End: 244-1851
cgagtcccggggcccaggcgcctcgtgatgtcaccgcagcttgatacaaagagcccttcggcccacgcgggtctcccggcaacgggcgggggcggggccgcgccttccactggtgcccagaagtgcgagcggcagcggcgcggccgcgattgttcctgcgcttcggggctgcccgccgcgtccccgcgcgccgccgacccgcgcccgctggcttccgcgcctctgccggggagcggcccgcggatgcgcaccccgccagctctcgggagccagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccagggtgcagcagttggaggaagaaaatacagagcttagaacaacagtgactcggctcaagtctcaaacagagaaactggatgaggagcggcagcgcatgtctgaccgtctggaggacaccagcctgcggctcaaagatgagatggacctgtacaagcgcatgatggacaagctgcgacagaaccgccttgagttccagaaggagcgggaggcgacgcaggagctcatcgaggacttgcggaaggagctggagcacctgcagatgtacaagctggactgcgagcggccaggcaggggccgcagtgcctcctctggcctaggcgagttcaatgccagggcccgcgaggtggagctcgagcacgaggtcaagcggctcaagcaggagaattataagctgcgggatcagaacgacgacttgaatgggcagattttgagcctcagcctctacgaagcaaaaaacctctttgctgcccagactaaagcccagtctctggctgcggagatagacaccgcctcgcgcgatgagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccacc

SEQ ID NO: 173036 - DNA, 596 bp, Homo sapiens
  Payload ID: 14003
  Gene Symbol: RAB11FIP4
  Gene Name: RAB11 family interacting protein 4 (class II)
  ENST ID: ENST00000582009
  CDS Start-End: 108-596
ccctgaagccgtgtgctcagggagggtgtgctcagggaggagccggtgttggctctgcttttctttgcccgagttgtctgtcaccatggggagaataaagtggccccatggctgatactgaccccagggtgagggtggaaaaacttgtgaaatatttggatcccaacgacctggggagaatcaacttcaaggacttttgccggggggtgttcgccatgaaagggtgcgaggagctgctgaaggatgtgctgtcggtggagagcgcggggacgctgccgtgcgcgccagagatcccagactgcgtggagcagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacc

SEQ ID NO: 173037 - DNA, 487 bp, Homo sapiens
  Payload ID: 14003
  Gene Symbol: RAB11FIP4
  Gene Name: RAB11 family interacting protein 4 (class II)
  ENST ID: ENST00000578694
  CDS Start-End: 52-204
gccgacccgcgcccgctggcttccgcgcctctgccggggagcggcccgcggatgcgcaccccgccagctctcgggagccaggtaagcggcggccccggggctggcgctcgcagggctccggcggcgcgcacctggctcggcccggcccgcggccccgggaagttggcggagagcggacttggcctgggaggtcgtgttacctgagccatctcgttcggccgcgagtagaagccgctgccagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactcca

SEQ ID NO: 173038 - DNA, 567 bp, Homo sapiens
  Payload ID: 14003
  Gene Symbol: RAB11FIP4
  Gene Name: RAB11 family interacting protein 4 (class II)
  ENST ID: ENST00000583755
  CDS Start-End: 188-567
actggtgcccagaagtgcgagcggcagcggcgcggccgcgattgttcctgcgcttcggggctgcccgccgcgtccccgcgcgccgccgacccgcgcccgctggcttccgcgcctctgccggggagcggcccgcggatgcgcaccccgccagctctcgggagccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaa

SEQ ID NO: 173039 - DNA, 618 bp, Homo sapiens
  Payload ID: 14003
  Gene Symbol: RAB11FIP4
  Gene Name: RAB11 family interacting protein 4 (class II)
  ENST ID: ENST00000579589
  CDS Start-End: 126-278
agaagtgcgagcggcagcggcgcggccgcgattgttcctgcgcttcggggctgcccgccgcgtccccgcgcgccgccgacccgcgcccgctggcttccgcgcctctgccggggagcggcccgcggatgcgcaccccgccagctctcgggagccagcaccaacctgaggttccacagccagtgtgtgccagatccagaactgaaccaaatctgcccaagagcctcagtctccacatcttcaagcccaggagtttgaaaccagcacaggaaacgtggtgaaaccctgtctctacaaaaaatctgtaaaatagggtgatttattacctccctctgggggtgatgcaagaagcctgcttgcttctcatgtgaaatgaatgagcacctggggaaccccagttgtcccggttgcccccgctcctggggtctgcaggcccaccttaggatggaagtggagcgcagcaaccaggtgtctacacaagatccactcctagaagctgcagggcgggagcagtgggccctgctgaggggtggtcttgagctcctggccacaccctttctgggggcagcgaggtcacaggccccacctttgctgatggcgagctcatccccagggaacccg

SEQ ID NO: 173040 - DNA, 8628 bp, Homo sapiens
  Payload ID: 14003
  Gene Symbol: RAB11FIP4
  Gene Name: RAB11 family interacting protein 4 (class II)
  Uniprot ID: Q86YS3
  ENST ID: ENST00000621161
  CDS Start-End: 230-2143
ccttcccctccccactcttctccttccctcccctcccctcccttcccctccggagcggctggggctgcggcgccgctgctgacacggatcggccgcggccgccaccgggcggaggctgcgcggcgcagacccagacgggcggccccggagggcgcgcggcgatggcggcggcgggcaggcggcgggcgcggcgggcgaggggtccgggctgagctgcgggccggcccggatggcgggcggcgcgggctggtcgggcgcccccgcggctctgctgcgctccgtgcgccgcctgcgcgaggtgttcgaggtgtgcggccgcgaccccgacggcttcctgcgcgtggagcgcgtcgcggcgctcggactgcgcttcggccagggcgaggaggtggaaaaacttgtgaaatatttggatcccaacgacctggggagaatcaacttcaaggacttttgccggggggtgttcgccatgaaagggtgcgaggagctgctgaaggatgtgctgtcggtggagagcgcggggacgctgccgtgcgcgccagagatcccagactgcgtggagcagggcagcgaggtcacaggccccacctttgctgatggcgagctcatccccagggaacccggcttttttcccgaggacgaggaggaggctatgacgctggcgccacctgagggcccccaggagttgtacacagacagccccatggagagcactcagagcctggaggggtctgtcgggagtcctgccgagaaggacgggggacttgggggcctgtttctgccagaagacaagtccctggtccacactccatccatgacgacctcagacctttctacacactccaccacctcgctcatcagcaatgaggagcagtttgaagactatggggagggtgacgatgtggactgtgcccccagcagcccttgccccgatgatgagaccaggaccaacgtctactcggacctggggtcttcggtgtcttccagtgcggggcagacgcctaggaaaatgcggcacgtgtacaacagcgaattgctagatgtttactgctctcaatgctgcaagaaaatcaacctgctcaatgacttggaagcccgactgaaaaacctgaaggccaacagccccaaccgaaagatctccagcacggcctttggacggcagctcatgcacagcagcaacttcagcagcagcaatggcagcaccgaagacctgttccgggacagcattgactcttgcgacaatgacatcacagagaaggtaagcttcctggaaaagaaggtgacagagctggagaatgacagcctgaccaatggggacctgaagagcaagctgaagcaagagaacacacagctggtgcacagggtgcatgagctggaggagatggtgaaggatcaggagaccacggccgagcaggctctggaggaggaggcgcggcgccaccgcgaggcctacggcaagctggagagggagaaggctaccgaggtggagctgctcaatgccagggtgcagcagttggaggaagaaaatacagagcttagaacaacagtgactcggctcaagtctcaaacagagaaactggatgaggagcggcagcgcatgtctgaccgtctggaggacaccagcctgcggctcaaagatgagatggacctgtacaagcgcatgatggacaagctgcgacagaaccgccttgagttccagaaggagcgggaggcgacgcaggagctcatcgaggacttgcggaaggagctggagcacctgcagatgtacaagctggactgcgagcggccaggcaggggccgcagtgcctcctctggcctaggcgagttcaatgccagggcccgcgaggtggagctcgagcacgaggtcaagcggctcaagcaggagaattataagctgcgggatcagaacgacgacttgaatgggcagattttgagcctcagcctctacgaagcaaaaaacctctttgctgcccagactaaagcccagtctctggctgcggagatagacaccgcctcgcgcgatgagctaatggaagccctgaaggagcaggaggagatcaacttccggctgaggcagtacatggacaagattatcctcgccatcctggaccacaatccctccatcctcgagatcaaacactaaggcacggggctggctgcagagcagccttaggaccctgggaccaagggcagaccctgcccaaggatgcaggcctaagccgggcctcacactcacactgtaaatgtctctctggccaccatgcgttacgtgtacccgtgtatatgtggggaggctgtgcacacgagcgaggggtgagtggccgtggctgtgggcagcatccacacggttagccgtgcatgcactttgtggcccctttgcaaggggcagagggtactggaagtgggaggaggcaaggtctgctatcaggagttactgtaaaaacaagaactggaagctcgtgtttccggtactgggtaaaatgattctacctctggggataaggattcacattcgctctagtacgatgggctctttcaccccactcctagtccccttgggagtgggagcaaaattgtgatctttcctaggagtttgaatgccccatatttgtgtcctcgccagctctttggccacctttcaagccccagtgttcaagctcagagaggatgaaggggcatctggagggtccatgagatggggccctcaccaaatgccttggccaccggccagcagccctctgtgatgtgtgtgcagagtgaacagaggactcaggtttcatagcagctagtgcggggcatcctcatcctgtacctatagagttcgtgcactcccccatccatgctacctacctccccgtttctgtttcagttttaagacaatgaagcagcattcactgcgtcattgtaacatgaagggataaaaatgaaggagaaggagggtttgggatgggtgtctaaggcaggagttgacatcgggcaaccaaagaaatgagttttggggaggaacacaactcccatcccagtcagtttccttcccatggctgcatcttaagatggatgcacggagaaaccgtctgcctggctccctgtcttcattctccacgcagcctggtgatggcaggcctgggtttggatttcagaatcctagctccgggctccactcgtgtggcagcaagactgcttcgttccagcgtttagaaacacacctgtatttgattctcagccaggggagcactcgctgcactggtgggaggcggttgggaaagttgcaggaaaaccttagtcttccatccttctgacccatggtggaaattcacaccatggatttttaatggatctttgttctaggcagctgggaatagacatggtacttaccttagagttttccaatttatctcaattttatatggcttgtgattcattttcttaatccaaatatatataaacgtgtgtggtcttattcttccccctgcagtttcttgctttcttcagcacatcttatagtatgagaaggaaggtttgggcatgttgggaagggcggtggagggggagttgcagaaagagagggcagtgagggtgaggagaggggatctggggacttgggtgtgacacctgcttgacagaggcagggctgtggccaggaccaaccttcaattccattccaatcagcctttgcatttgttggatctcgtggcttctttttaatcttttgttggggattagtttcatgctgcacataatggggttgcactggtctgacccaggactttggagccacccacactgggaagactaggctaggcagtcggtcttctaggagtttctcagccccttaggacgcgggtctccttgggctcccccaagggttctgcgaagaggcagtggaagaaggcatgaggagagggtctcttgagaatttgccaataggaaggagtggccacggctgaaaggaacaagacagatcctgacatagctttggcctgggtgttaggtcagaaggagtactggtgcgtgggggccttaccccagggttgagtattttatctgtaaaatgttatctgccctttggctgcattggaatttcagagaaggctgcagaggcctgggttacacagcctgagtcacaacgtgggaaggaatctctgccacgggaaaggtgggcggaagcagctggcagcctggggcgtgcttcaggctcctccctctaaggggcgccatgggaacaggctccggagggagccggcgtctgaaaggcccccgggacctgctgcagtgccagaggggcctctggagcaggcctggcttttaaatggggggctgaattccagctcacacacacctcaagtccaaccttactttcttcagccagaatacatttcttgtaaaacctggcttgttgcttggcttttaaagatggtgtatgtttgtaaaaatattcttctgggctcaaaagctagcttgagggggcagatgccccaggtgtcccagctccacagcccctggcagatcccagaccccttggtggcaggtcccagagcctaggtggtaggagcttgatctttgtttctgcccttacccctcagtagtggggctgcgaggtagtagacaggatgcccagttaagtttgaatttcagatagaaaataattttagaataaatatgttctatctaatacatgggacagatgttatttttagagataggatcttgctctgttgcccaggctggagtgtagtggtatgatcatagctcaccacaaccttgaactcccaggctcaagcgatcctcccgccttaactgcctgagtagctgggactacaggcatgcaccaccacgcccagctaatttttcttattttttgtagagacagggtctcactgtgttgcctcactcgagctgctgacctcaagtgatcctcccacctcagcctgccaaagcactgggattacaggcatgagccaccatgcctggccaggacatatttgaaatggggagattttaaaaattctgatgattagactgaatcctcagacgttctggtttgattgttgtgggtgtagcccaggcatgggattttttaaagagctgctcaggtaattccaatttaattgcgtgtcctacttgggttttttgtttgtttttattgtttttgctaaacctggcaaccctaccgagtagggattagcagtaacttatctgaaatttagaggtgttttgggggtggggcgagggtttctgtagtagactcagattttacatggccctgagctgcccttgcgttcagttggaagccacgcaaaatgaactgaaccaggagtgagcttcgtgtacattatctattagaaaatgaagtaccttctggttcagctagtccctgtgcgttgagaggctttaagaaacttctagtaaaaatgtttttttcttttagctttgaattggccagagtttatcctagattattttattttaaattggtagaattctttgcgaactgtcacagagaaattccttttcatgactttatttctgacctattaaaacatgaacaggccaggcatggtggctcacgcctgtaatcctagcacttgggaggcagtggcaggcggatcacttgagctcaggagtcctaaaccagcctgggcaacatagtgataccttgtctctaccaaaagttaaaaaaaaaaaaaaaaaagctcaagaacctgcacgagggcctaaaacagtgggctcagctttggctgtgcattggaatcacctggggagatttgtaagcttctgctgtctgggctgaacccccagaggttcggattgaattggtgtggggtgtggtccaggcatcgagatgtgtaaagacctccccaggtgatgatatgcagtccgaggttgagactgccctgtcctgcaaggtcgttggccagaggtagaggaaactggtcaaagtggctgttgggcttgtcaagcccgtggctgaatgacagtgagctctcttgctgggagggttccttttcctgttgttgaatggtcctggcctgcaggatgggaggccagatgccttcaggagctggtggatccagctgttctcaccagcctggaggttagcagaccagagtgggtgggcaggaccttggcctggtgcccctggaatcagtgggtggcatgtgttgggatatactggctacaggctcatctcaaagagcaggtagaacagagtcagcagggaactgacaggtggggctgtccccctgaaagcagccgcagaaacagctgccacctatttgcatagctgagcaggaggacatactgtctttgtgggttttgcttctggtctgtttcctgactgggttgataaagggagtcccagctcgttccctgttagccaaaccagcatcctactcacacaccggacactccaggtgctagtccactggtgctggtgttcaggggagttggggggggggggcgcggggacagaagcgcgggttcttggttccaatgagggacttagcagaagcctccaggggccagcagggccaggtgaaactgggagaaatgaagccctctgtgtcctgtgtgtgtggtggggtttaatgcattagcaaatttaaacttaaaaactaactctaggccgggcacggtggctcacacctgtaatcccagcactttgggaggccaaggcaggtggattgcctgagctcaggagttcgagaccagcctggacaacatggtgaaactcttgtctttatttttttaaaaaaacaaaaagtaactttcgatgtgatcataccaggaaagttttgcgtggtcaccatgccaagaaaatgactttggttgcccagcagatccacagcgactctttctcaagggctactgtggattctagattgaggaaaggggccacttaggactcagtgctggtatcctccacagtcctttctcccagactctggccctccctttgggacccaggaaatcccctctagggtgacgctgctggctaggaagactgaggtctgctgcgccaaggggcctcaagttagaagggccatgccgtcagtggatgactttgagcgctgatcctagggacctgccaggtcctcacttcctgccctgggtgcacacatgaatggggcagccagcaggaagcgggagaggctggaaccaggagcctgccctacctgcatggcaggacaactctgaggcccttctgccatattctctgctacccaccagagaaaataggctgccttctagaaagatttgtttctaaaagcgtagaccctggggaagtataatgtcaccatgctcaccaggcgaggtttcccatatgacctccctgccccgacctcgtaggttgctcctttccccatctgtaaggtagagatgtctgccccggagctaccagctggggatggcatccaggccatgtctcctgcaggatccaagtgctgttgtccccagggtgaccctgcctcctgctggggcccatccgctttgctgtgctgcacaggctgttttcatctgcatggtttggggtctttgtccttgtgccttttcttccccatcgccactgtacaggattttccacattgcccactgcctccttttctacatcgtctcatctccctggcctttcccgagccctgtaaatgtgtactttttcaacgtgcctcccccaggtgaggccagctctcccgggcacattcgtccacaaggatcaggccccacttacccttggctcgctcagcctgtagacttggtaactttgtacagaatctttcattattgtcttaagcatggggggctaggacccacttagtccctcctccagcctgcagctaatttaggagccttgcattccagaaaagggcaactttgtgtaaagcagcttctcccacagagctttccctgcattgttagtgatgtcgggcaaagcatcactctttaacctggggcattggccccagcagggatatcatgggaccgcagccgctccgtgcactgtctctgcccccagaggaagccctgtccatggttcctggtgcacggccacaggcctgccttgaggccaccacatctggtgtctagaacagctgcgggccccacttgggcagaaggaagaggtgctagctgctgcccctgcctgctgtgaacacctgcccagcccttccttgtctgctgaggtgctcagaccagagtgccattaaataccaactgatgtcacggagcggacggtgcattgccaaggactcacagctgtgggctcccttccagctcctcccactttcttggctgggtcttctgaggcctacgtggaatgaactacacatgtggcctcatgcccaagggtttgttagatggcctctgactctgtgggattcaacttgacttttttgccccaggaggctctgtctggaaacaggcttagctttagtgctggggtgggacctgccctgtgggccccagggaggggacagtgggggtgaggccctgaggctgtccagggtctgagctctttgcctccaacctgcttctgccccaaaaggaacaggctgttggtggcaggctcctcccggggagctgtactgtacagaccaaggtgtaaataaacagtttgctcttctcgcctga

SEQ ID NO: 173041 - DNA, 4342 bp, Homo sapiens
  Payload ID: 14004
  Gene Symbol: RAB11FIP5
  Gene Name: RAB11 family interacting protein 5 (class I)
  Uniprot ID: Q9BXF6
  ENST ID: ENST00000258098
  CDS Start-End: 242-2203
gccggttggggcggcgggcgcggggcggggcagggggcggggcgctgacgtcgcggcgcggcccgcggccagcggcccggtgaggcggggaggcggcggccggtcggcccggcccagcccagcccgcagctgcggcggcgctcagagttggttcctgaccgccttctgccgcggccgggtttgtcaccaggtcctggggtctgcaccggctcggccagacctcgccccccgcttctccgccatggccctggtgcggggcgcggagccggcggcggggccttcccgctggctgcccacgcacgtccaggtgacggtgctgcgggcccgcgggctgcggggcaagagctcgggagcgggcagcaccagcgacgcgtacacggtgatccaggtgggccgcgagaagtacagtacgtcggtggtggagaagacgcacggctgccccgagtggcgtgaggagtgctccttcgagctgccgccgggggccctggatggcctgctgcgggcgcaggaggccgacgcgggcccggcgccctgggccgcgagctccgccgccgcctgcgagctggtgctcaccaccatgcaccgctcgctcatcggcgtcgacaagttcctgggccaggccacggtggcgctggacgaggtcttcggcgcaggccgcgcccagcacacgcagtggtacaagctgcactccaagccaggcaagaaggagaaggaacgcggcgagattgaagtcaccatccagttcacgcgcaacaacctgagcgccagtatgtttgacctgtccatgaaggacaagccaaggtctcccttcagcaagatcagggacaagatgaagggcaagaagaagtatgatctggaatctgcctctgccatcctcccaagcagcgccatagaggatcctgacctgggcagcctgggcaagatgggcaaagccaaaggcttcttcctccgcaacaagctgcgcaagtcgtccctgacccagtccaacacctcgctgggctcggacagcaccctgtcctcagccagcgggagcttggcctaccagggacctggcgccgaactcctcacccgctcaccaagccgtagcagctggctgtccactgaagggggcagggactctgcacagtcccccaagctgttcacccataagaggacctacagcgatgaggccaaccagatgcgagtggctcctcctcgggcccttctggaccttcagggccacctggatgctgcctcccgctcttcgctctgtgtcaatgggagccacatttacaatgaggagccccagggccctgtgcggcaccgcagctccatctcgggctcgcttccatcctctggctccttgcaagctgtctcttcccggttctccgaggaggggcctcgttccacagatgacacctggcccagaggcagtcgtagcaacagcagctcagaggcagtgcttggacaggaggagctgagtgctcaggctaaagtcctggcccctggggccagccaccctggagaggaggagggggcccggctaccagagggcaagccagtccaggttgccacacccatagtggcctcctctgaggctgtggcagagaaggagggagcccggaaggaggaacgcaagccccggatgggtctcttccaccaccaccaccaaggcctaagtcggagcgagttgggtcgccgaagctctctgggggaaaaggggggtcccatcctgggggcctccccacatcactcatccagtggggaggaaaaggccaagagtagctggtttggcttgagagaagccaaggacccgactcagaaacccagtccccaccccgtgaagcccctcagtgccgcccctgtggagggcagccccgacaggaagcagtcccgctccagtctgagcatagccctgagcagtgggctggagaagctcaaaacagtcacatctgggagcattcagcctgtgacccaggccccccaggctggccagatggtggacaccaaaaggctgaaggactcagctgtgctggaccagtcggccaagtactaccacctgacccacgatgagctcatcagcctgctcctgcagcgggagcgggagctgagccagcgggacgagcatgtgcaggagctggagagctacatcgaccggctgctggtgcggatcatggagacctcacccacgctgctgcagatccccccgggcccccccaaatagccttcctcaccctacccccaggagggttggcatggacctattgctgcctgccctctctcctcctgaactctctcatctgcagtggggcatcgtctgtcttgccttgtcactccttgctcctctccctcctgcctcaactggggctgctggaagggggccctctggattccctttggaggcatcaggttctgtgcacaacttgtgtgtctttgggagccctgggtctttcccacctgcctgttttcatatccctcagctttgggggccccagggaattggaactcttcccccaagacagagcaggggtgaactgtagcttgatgcagtaatctgggacaagactggttgctagcacatactttattatcccccaaggatggtcagccatttcttcccacagccaaagccccatccccttcatttccctccagtccctggaggggcttctagtattactgggacaatgaccacgctgcctgtttgtctgtgagttacgggcaaccagcctcttcagcctcacacccattcccctgagagcaagaagcctgtgtggtctgggccagtctctgccatgtcctgagtctgcttcagtctggagctgtttgtggggcgagtgccatgtggacagtggtggatgatgtgtgtgcttcaggctgctccctgacccctctgacctttccacgagtgtcacatgggaatgtgtggggcgcaggggcgggtgcggagagagcacctttttgcttttcgagctcttgaccacctccaatgtgtaggtccctccaggctggggcttgggactgcttatgatttggggatcaagcctccatgtctattcttgttgcctgtccagatgccaaaactctgtgttgctgcagggtttgaacttttggaaaccaattaaaatgtgcctttggtgggcggggtcaagagcccctggatgtcgacctctcccgctgtgtggcgtccccctcccacctgttgaatacatagggatggctctctcagggccctgggaatgggaatggacagcactgctgtgggctgttcccctcccctaaagttaatctcttggtctggccaagttgctgctccctcaaccttcctgctgtcttcccctccctcaaccccaataggaggatcccaggataaacactgctgggcaggcgggcaggcaggcctggggctgccctgctcactctcattgtctggcctcaggacttagccatactagaccagtcagcttgcctggaagagggaggtcccactatgcctttgggagacacctatacttaggaaaaagcctttgttgtcctcccatccatccattaagctgctatctcagcctgtcccttctgccccaggggcttgcctggcttggctgcagtgcactttgaaatgaagtatctgtcctttggcccagcccctggtttgcttgtagaaaacatggtaggcttccccaaggcatctgcagggaactttggcagcttggggcaccctgaattagcaaaaatggggggtgatgaggtgctgaagaaggatacttaacagcttagtgaggaggcaagagctcctctgggaccaccacttcttcaggagagggcctgtgggcttgcttttggaaggcctcaggcagacacgtgccctctgggtgatgtctgtctgctgccaggatggagcagaggagcgccacacatggaggaaagcccctgtaacgttacctaccttaaactccactcatcaaatctgagaaaagtatccactggtccccagggtttcagtcatgcttttgggggtcattgggtattagagaagtaagtatcttttctgagagagggggagtcaccccccctactggggattcctctgggctttattcactcccagccctggccctgacctttgtgggcctccctaatgcccagggcatggatggcttcagaggagtttttgaatcgaagcccagggtccttgttgatgtttcttctcctagccacacttggaggaaagttgcaggtgggttgggcagggagcaggcatggttctgctttgctgtttgtcttcctagttaaggctctttataaagagcttgttcttcatgttttaagcactttatgaagaataaaacattcatgtactgca

SEQ ID NO: 173042 - DNA, 4930 bp, Homo sapiens
  Payload ID: 14005
  Gene Symbol: RAB11A
  Gene Name: RAB11A, member RAS oncogene family
  Uniprot ID: P62491
  ENST ID: ENST00000261890
  CDS Start-End: 129-779
agcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagcggtagattatgtggcattttattgctcaggcaataattggtttaatgctggtagtgtcaaattttgaagtgttaattttgtcttagaaccttccagtaagtgaaatacaacctagttttatcaccatatccaccagcaggcatggataattattttaacaatgctaatatttgagttttgcagtatattatagaatatagtccagttaaatctttggtttcagtatgtctgaagagtacagtgagaggttaatttctgctcaagtggtaccacttaaaggcatgtattcttttagtatgtaaaatgaaatagtaccttgagtttaaatagaatgcatttaggcattgtagagatctgaaatagttttcttccactacattgttgaaatcaatgaagcaattagtttctcattcagaaatgtgcacactaatatttagttttgctttctcgtggataatattaagcacttactctgcagtttcctggaagttgtgtcaactgcagtgatactattcaggatggtgggaaatccccaaaaatatgtatgtgtgggcttgcttagattactatatttcatagttaatcttttgtctcttgcggtgctcatgatgtgtggggcacacggaaggcattgctgtagtcagtcattttggttttcttctatagccattttattattttagtgtattagttatgaagataatattatctatttgtaaattgctactttgtattttatgcatgctctgtaatttgatttttttttagttattgatttggattatattcacattctaataaacagttatagggggattatttcttatgctgtcagattacatttttcctttgagtgctttgggtgcagccgtggaatcctgatgtaaaagcataggttcttgcattactgagtaaacattgaattgggagcatcagtgtgtgaattcagctttgattttagaactgcagttcaattatgctttccttggaaaaagtatgtccaaaaacattaggaaagtagtgtgtattttcatatataacagtgtcaccagacccaggaaaagaaaccatctctattttattgaaagttggtggtagattttttacaaagtaaggagaaaagagaaaaactaaatagtgaattgaaaatgaataaagtaaacttagaatttttacccaagtgtagacttaaatgttgctttgagtatggctggatcttgggagaattccaggaaatattaggtattagaaaatgactttgattgcatttcagcaggtgtctttattctgagtagtatcttaggagacaaactgtctcaagcaagaaacaataaatttttaaatattatgacagttcagggcttaaggcagtttagaagtattttgctacttgaccttgattttcagttattttaactttgaatttttttttttttttttgagacggagtcttgctctgttgcccaggctggagtacaatggcaccatctcagctcactgcaagctccacctccagggttcatgccattctcctgcctcagcctcccgagtagctgggattataggcgccagccaccacgactggctaattttttgtatttttagtagagacggggtttcaccatgttagccagggtggtctcgatctcctgacctggtgatacacccacctcggcctcccaaagtgctgggattaaaggcgtgagccaccgtgcctggccttgaatttttttttaacctgttatatagtctcctgaatagttagccatggtgccttgatttaatcttatgtcattgttctcaaatgccatgatttctctttaatagtagttgtcattatgtaagggtaagttattgcccatttaattgtaattataagaagaggtgccagctagtgaccttacatcagtgatcttttaagttctgaagggttctgcagaaaagttacacttcttgagtttgggttgcccatcagagctggtcacatttctttgatcattgaaaaaatgaatatcttaatttttgtctttgctgactggtatttataaaatacaaatgcttttagtgggttgagctgttgtgataatctcttccatctaccttagagaagaagctgtactatttagacagttttggccaacactagaagcaaaagaattcaaaggctgggtggatatttaagaacttattctaacctgtcaggtttcaatttgtggggcttggtttaacagaggaaaaaaatataaattgattttctgatgtctcacaaatatcacatacctggaaaaaaattaaaacaaaaaatgaattttgtaaaaggttatgtatgacttccatttgctctgtaaaaaaatgaacaaagattgtgaaaggatcctcttccaccacatcatttaatgggttagcggaacagatagggagctatgacactagcaccaaagagagatttttcttctggttgggtggtgctggtgccacgcccctttctgggatttgacaagtctttcccactcacctatacaatatgccaaatcaactggagttgtcattctaatgttttaaagaatgattgggttcccccaaactgtaggaggtcgatggtaacaataaagtgatacaaaatgcttatgtcattataatttatgtaagggagaccattaggctgagaatcaatatgattgaggttatctattctcctgaaaagtgaattggagaataaagaaagaatatttgaaaggatgttgtgtactaggcaatatactagcatgtattagaaaatacggtaaactgtgggttagaagagtgaaagtagctggtatgatagagcactggactgagtaacgaagagattctagtcatggctcttgtggtcatttcatttttgagcctcacattcttccaattaatgagggtaccagattaaataaactctggggattcatcccaattcgaactctgtaattctctgaatgaactctctcttcaattaaagccaaattattaacattttaactcaagtttaaatttaatagagaagtcaaaatgaggtatgcactttgtggaatgtttttggtcttatcacaataacctgattaaaatggtgcctttatttccatgtttactcctttaaataagatgaaagctttcagaacatttatttgcaaaatgactgtcaatatcaacaatatgcatcaaagtaccatatatgctaagggagaggagcacttgatgggctgctatgttaactgtaaattgagaactgcttgttttatggcttttgctgttaaaaaaaaactgctggcttttaatatgtactttaaaatatactcatgtctgggagagaacttttaaaaaca

SEQ ID NO: 173043 - DNA, 588 bp, Homo sapiens
  Payload ID: 14005
  Gene Symbol: RAB11A
  Gene Name: RAB11A, member RAS oncogene family
  ENST ID: ENST00000566233
  CDS Start-End: 123-588
agggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagagatttaccgcattgtttctcagaagcaaatgtcag

SEQ ID NO: 173044 - DNA, 635 bp, Homo sapiens
  Payload ID: 14005
  Gene Symbol: RAB11A
  Gene Name: RAB11A, member RAS oncogene family
  ENST ID: ENST00000567671
  CDS Start-End: 391-635
ctctcccgaagcccctctgacgggttcttcgcttccctcttggccttgccttcggtgcagactcccattacagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttcc

SEQ ID NO: 173045 - DNA, 978 bp, Homo sapiens
  Payload ID: 14005
  Gene Symbol: RAB11A
  Gene Name: RAB11A, member RAS oncogene family
  ENST ID: ENST00000564910
  CDS Start-End: 131-571
gcagcggcagggaggggctcttcacccagtccggcagttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatggtttgtcattcattgaaacttcggccctagactctacaaatgtagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactc

SEQ ID NO: 173046 - DNA, 1396 bp, Homo sapiens
  Payload ID: 14005
  Gene Symbol: RAB11A
  Gene Name: RAB11A, member RAS oncogene family
  Uniprot ID: P62491
  ENST ID: ENST00000569896
  CDS Start-End: 46-513
acagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaaaagaatgaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccctagaaggctgtgtatagtccatttcccaggtctgagatttaaatatatttgtaattcttgtgtcacttttgtgttttattacttcatacttatgaatttttccatgtcctaagtcttttgattttagctttataaaatcatccacttgtcccgaatgactgcagctttttttcatgctatggcttcactagccttagtttaataaactgaatgtttggattcctcagttattgtttacttttcatcatggaagcctgtcactgtatgtaggacataatagaacttgatcacttgaagctcagacctattggtcttgatcaaatcaaactaagaagaccttagaaataagctaccattttgccacagagcagcttataggtaatacactcttctctcagtgcagtgtacatttccacaaatctaagaattgccctataaacatagcaggattttgagagcttgaaaattttccattattctggacatgaatttctaaaatgccttaataggtttatgtagttgagtaaattttgttttttaatttttgtaagcatcaaagttgattagagaggggggcactttttctggagaattctcttagtaaacacaaaagattgttacggtttcattagtagtatggttgtggggccataagttaaacagtgctgcctggtaggctgggaactgaagagacttgtggtattccatctcgggtgcctctgttggcaatgatcaggcagcccaaaagatttaaatgatctataataatttccaagc

SEQ ID NO: 173047 - DNA, 711 bp, Homo sapiens
  Payload ID: 14005
  Gene Symbol: RAB11A
  Gene Name: RAB11A, member RAS oncogene family
  ENST ID: ENST00000565075
  CDS Start-End: 96-692
agttgaagctcggcgctcgggttacccctgcagcgacgccccctggtcccacagataccactgctgctcccgccctttcgctcctcggccgcgcaatgggcacccgcgacgacgagtacgactacctctttaaagttgtccttattggagattctggtgttggaaagagtaatctcctgtctcgatttactcgaaatgagtttaatctggaaagcaagagcaccattggagtagagtttgcaacaagaagcatccaggttgatggaaaaacaataaaggcacagatatgggacacagcagggcaagagcgatatcgagctataacatcagcatattatcgtggagctgtaggtgccttattggtttatgacattgctaaacatctcacatatgaaaatgtagagcgatggctgaaagaactgagagatcatgctgatagtaacattgttatcatgcttgtgggcaataagagtgatctacgtcatctcagggcagttcctacagatgaagcaagagcttttgcagaagctgcttttcagacaattttaacagagatttaccgcattgtttctcagaagcaaatgtcagacagacgcgaaaatgacatgtctccaagcaacaatgtggttcctattcatgttccaccaaccactgaaaacaagccaaaggtgcagtgctgtcagaacatctaaggcatttctcttctcccct

SEQ ID NO: 173048 - DNA, 1751 bp, Homo sapiens
  Payload ID: 14006
  Gene Symbol: RAB11B
  Gene Name: RAB11B, member RAS oncogene family
  Uniprot ID: Q15907
  ENST ID: ENST00000328024
  CDS Start-End: 219-875
tttctccaggacaccgagggcgaggagggtggtaccaagcggcgcccaccctcagagcactacttccatctctgattggcttcgctgggtgcccgtcgctactccactcgccgctgataggccattcaaccgccgctctgcgcggcgccggctccgcccccgtcgggtgtttgtggtggggctgcggagtcgccgatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacagagatctaccgcatcgtgtcacagaaacagatcgcagaccgcgctgcccacgacgagtccccggggaacaacgtggtggacatcagcgtgccgcccaccacggacggacagaagcccaacaagctgcagtgctgccagaacctgtgacccctgcgcctccacccagcgtgcgtgcacgtcctccgcccgcccccgccacggtatcctctggcccctccctgctgtccctctgtggccggctcgttccagccctcccagtgagctctgcacggccgggccggggcccaggaaggacaggagccagtgctaccccgtcctgcccggggaaaagctagaagccccggtttgctgcacccatgaaactcgggtccccacagcgtcttggcggggtggggagggcggcaggatggacggggctggccagaggcgaggaggacgggcggacggcgccgccttctccccttttccttggccgactctagggagcgattgcctccctccctccgtgaccgggtggcccagccagcccgtcgtccccacccagaaccgtgctctgggccaaagcccgaagaaccaggcagcgggggccggggcaggcggaccccccgggctctcagcgcccacccgctcctccgcacacagcagctcgcacaggcctcccacctctgcctgttgattgatgcagggagaagcccgtccccccctctcccctctcccctcccctctcctgcacgcaacgcgccctctcggccctccctgtccccctcctctgtctcgtctccccatctggtctggaacctgtttgcaagtgaagcaatatctccgtgttttgtatatacaaccgctcttgtagcctttggtttttgttaatgtagagaaacacagattctttatacactttgtaagatttacgccaaaccccagctctcgatctcttcttctccctgtggcccctgcgctgttgccccgtccccgtcaccccgcccgttactgaaatgtataatctgacttcctgtacagaaa

SEQ ID NO: 173049 - DNA, 894 bp, Homo sapiens
  Payload ID: 14006
  Gene Symbol: RAB11B
  Gene Name: RAB11B, member RAS oncogene family
  Uniprot ID: Q15907
  ENST ID: ENST00000594216
  CDS Start-End: 25-564
gatcccgccggaagcgccaggacaatggggacccgggacgacgagtacgactacctattcaaagtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacaggtggccggggaccagatgggtgtgggtagggcaccagccaggcagggtggaacacggcctctgaaccttcgcttgttttgttcgtttgcttgtttttttcttttttttgtcggggcaggatggatttttgctctttgcccaggctggagtgtggtggctcgatctcagcttactgcaacctccgccttccaggttcaggcaattctcctgcctcagcctcccgagtagctgggattacaggtgcctgccaccacacccgctaatttttgtaatttttagtagagacaggatttcacaatgttgtccaggttgatctcgaactcctgggctcaagtgatcctcctgcctcagcctcccaa

SEQ ID NO: 173050 - DNA, 577 bp, Homo sapiens
  Payload ID: 14006
  Gene Symbol: RAB11B
  Gene Name: RAB11B, member RAS oncogene family
  ENST ID: ENST00000601897
  CDS Start-End: 190-372
cgccgatcccgccggaagcgccaggacaatggggacccgggacgacgagtacgactacctattcaaaggtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattcaagaacatcctcacaggtggccggggaccagatgggtgtgggtagggcaccagccaggcagggtggaacacggcctctgaaccttcgcttgttttgttcgtttgcttgtttttttcttttttttgtcggggcaggatggatttttgctctttgcccaggctggagtgtggtggctcgatctcagcttactgcaacctccgccttccaggttcaggcaattctcctgcctcagcctcccgagtagctggga

SEQ ID NO: 173051 - DNA, 532 bp, Homo sapiens
  Payload ID: 14006
  Gene Symbol: RAB11B
  Gene Name: RAB11B, member RAS oncogene family
  ENST ID: ENST00000600719
  CDS Start-End: 394-532
atcgggacgttaagcatcgtagcattacctggacgtagccccatttctcttcccggacaggtcctctgatagtcggtggtgctcatcggggactcaggcgtgggcaagagcaacctgctgtcgcgcttcacccgcaacgagttcaacctggagagcaagagcaccatcggcgtggagttcgccacccgcagcatccaggtggacggcaagaccatcaaggcgcagatctgggacaccgctggccaggagcgctaccgcgccatcacctccgcgtactaccgtggtgcagtgggcgccctgctggtgtacgacatcgccaagcacctgacctatgagaacgtggagcgctggctgaaggagctgcgggaccacgcagacagcaacatcgtcatcatgctggtgggcaacaagagtgacctgcgccacctgcgggctgtgcccactgacgaggcccgcgccttcgcagaaaagaacaacttgtccttcatcgagacctcagccttggattccactaacgtagaggaagcattca

SEQ ID NO: 173052 - DNA, 2137 bp, Homo sapiens
  Payload ID: 14007
  Gene Symbol: RAB12
  Gene Name: RAB12, member RAS oncogene family
  Uniprot ID: Q6IQ22
  ENST ID: ENST00000329286
  CDS Start-End: 284-1018
gctgccgctactgcggagtagctgcttcccttcctcctctcccggcggcggcggcggcagcggcggaggaggaggaggaggggacccgggcgcagagagccggccggcggcgcagttgcagcgcggagcccacgggccgccggggccgctccagcgggcggaagccgagcccggggccgaccccccgcgcgcggcggaggccgagggggcgccggggcccggggcgcgcagccggggggcgggcggcggcgggcggcgggccgagcgggagccgcatgcgtgtatggatccgggcgccgcgctgcagaggcgggccgggggcggcggcggtctgggcgcgggctccccggcgctgtcgggcggccagggccgccggaggaagcagccccccaggccggccgacttcaagttgcaggtcatcattatcggctcccgcggcgtgggcaagaccagcctgatggagcgcttcaccgacgacaccttctgcgaggcctgcaagtccaccgtgggtgttgacttcaaaatcaaaactgtagagctaagaggaaagaaaattagattacagatctgggacacagcaggtcaggagagattcaacagcattacctcagcttattacagaagtgccaaggggatcatattagtatatgatatcactaagaaggagacatttgatgatttgccgaaatggatgaagatgattgataagtatgcttcagaagatgcagagcttctcttagttggaaataagttggactgtgaaacggacagagaaatcaccaggcagcagggggaaaagtttgcacagcagatcactgggatgcggttctgtgaagcaagtgccaaggataacttcaatgtggacgagatatttttgaaacttgtcgatgacattctgaaaaagatgcctctggatattttaaggaatgagttgtccaatagtatcctgtcgttacaaccagagcctgagataccgccagaactgcctccaccaagaccacatgtccgatgctgttgatttcctactttggagacaaagtggaaatgattcctggaaaggggaaaaaacgttctattctgcactacaatcattttgacaatttcctttcgcactttgtaatccaagtcagagctatacactaacttgtaaatatgcatatatgcaatcctgggtaagttttggttataagttacctatttccctccaaattattatatttcattcattaccccagtgtctagtgtacatacactgggaaacctagtacttctaatatgaagaatgggagaaatgaaaggtataatgtttcttgaaataaataatataattgtccttattaattatattatgaggacagaagatattctgataagagagaacgtggtgctttgcttaccgttttaaagaaaatttgtaaaactaaagactttttgaaaaaaagctatcttaagtgctttttctttatttacaagacatttcccccagtggtagcatctgaagtattggagtgtttctgccacgaagcaaagctccattcatggccgtcatggaaggttatttattaatgttacataatggtagaatattactagttagagggttggatttgacttggtcctaaggccacagaatctctctcatggcttcctaagggatgtacctttatgcttttaagaactacaaagattcaataaagaaagaaatgtttttgaaactatagaaaaagattttaaaacacgctgctgtcctaaacaaatcctgtttaaaggaattttaaagagatgcattttactatatcaaagaacatacgtgtatttgcctaaacactctgtacctttgtaatgataaaacttcccccttctttacggtgaagcttattctgattaagcctagactgtgttctttttttttttttttttttttttttttttttttttttttttttttggtctgatgatgaatttgtgaactctatctttggtatatcttttattaaactgcactgttttgtttagtcaaggtaattaagtaattatgtatttgaataacttggtgtgtcttgagtgttgtggtatgaaaagcattgtggtctttctacactaatgaagtgcaaataaaattttgtatttatgaatg

SEQ ID NO: 173053 - DNA, 1176 bp, Homo sapiens
  Payload ID: 14008
  Gene Symbol: RAB13
  Gene Name: RAB13, member RAS oncogene family
  Uniprot ID: P51153
  ENST ID: ENST00000368575
  CDS Start-End: 117-728
gggaggaaaacttcttcctggcctgggctccgtgccgctctgtttgccaaccgtccagtcccgcctaccagtgccgggcgctccccacccctcccccggctcccccggtgtccgccatggccaaagcctacgaccacctcttcaagttgctgctgatcggggactcgggggtgggcaagacttgtctgatcattcgctttgcagaggacaacttcaacaacacttacatctccaccatcggaattgatttcaagatccgcactgtggatatagaggggaagaagatcaaactacaagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgaggagaaaaaggagaaaagggaaaagcagaaaggaaaaaaaggaagagagaggaagggagaagggagaggaatgaattgaggaagtgaaagaaggcaaggaggtaggaagagagggaggaggaaaggaaggagagatgcctcaggcttcagaccttacctgggttttcagggcaaacataaatgtaaatacactgatttattctgttactagatcaggttttagggtcctgcaaaaggctagctcggcactacactagggaatttgctcctgttctgtcacttgtcatggtctttcttggtattaaaggccaccatttgcacaaa

SEQ ID NO: 173054 - DNA, 1353 bp, Homo sapiens
  Payload ID: 14008
  Gene Symbol: RAB13
  Gene Name: RAB13, member RAS oncogene family
  ENST ID: ENST00000614713
  CDS Start-End: 503-871
gggaaatagacaggaagagtctcacgacaattctggttacaaaggaaaaggaaaaatgcccctctttcctaattgtctcaaaagtaatcctgtttagcctcagactttcctagtgccaagtttggcccactagttaattcacatagactggcttcagctacttttttccttactctctactaggagggtaggtgggataccaagagtagagggctctaagaaaacagagaagaggaatgtgaaagtaatatctggggggagacagagactgaattcagagagttgtcagctggtataactgaatggacccaagaggcagcctaaggattttaagcctccatgcagaattttcgtcaccttttccctcccaaaatccataaaatgaattgatttcaagatccgcactgtggatatagaggggaagaagatcaaactacaagtctgggacacggctggccaagagcggttcaagacaataactactgcctactaccgtggagccatgggcattatcctagtatacgacatcacggatgagaaatctttcgagaatattcagaactggatgaaaagcatcaaggagaatgcctcggctggggtggagcgcctcttgctggggaacaaatgtgacatggaggccaagaggaaggtgcagaaggagcaggccgataagttggctcgagagcatggaatccgatttttcgaaactagtgctaaatccagtatgaatgtggatgaggcttttagttccctggcccgggacatcttgctcaagtcaggaggccggagatcaggaaacggcaacaagcctcccagtactgacctgaaaacttgtgacaagaagaacaccaacaagtgctccctgggctgaggaccctttcttgcctccccaccccggaagctgaacctgagggagacaacggcagagggagtgagcaggggagaaatagcagaggggcttggagggtcacataggtagatggtaaagagaatgaggagaaaaaggagaaaagggaaaagcagaaaggaaaaaaaggaagagagaggaagggagaagggagaggaatgaattgaggaagtgaaagaaggcaaggaggtaggaagagagggaggaggaaaggaaggagagatgcctcaggcttcagaccttacctgggttttcagggcaaacataaatgtaaatacactgatttattctgttactagatcaggttttagggtcctgcaaaaggctagctcggcactacactagggaatttgctcctgttctgtcacttgtcatggtctttcttggtattaaaggccaccatttgcacaaatgttcctgttttgggtaacttggattattgtcag

SEQ ID NO: 173055 - DNA, 4145 bp, Homo sapiens
  Payload ID: 14009
  Gene Symbol: RAB14
  Gene Name: RAB14, member RAS oncogene family
  Uniprot ID: P61106
  ENST ID: ENST00000373840
  CDS Start-End: 239-886
atcttggaccagcccgaggaagatactgagggagcacaggagcagtcaccgctgccactgctactgccgctactgctgccggcgcgtctgcacctctcggcctgccagtgtacctgccggcgcctcggtcgaccgcccccgccccctctcccgctgcgtccgcactcctgttcctggtcctgacgcccccctcccgcccggaaagctgcccagccaccagcaaccccccagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttggatctgaatgctgctgagtctggtgtacaacacaaaccttcagccccgcagggaggccggctaaccagtgaaccccaaccccagagagaaggctgtggctgctagtgacctctttgctgtggcccctcatttgacctttcacctctgtctgttggaagcagtactttttactgcctcattgtcttctgtacatcttactgggtttaattaaaaaaaaagaaaaaactctgttgtaaaaacagtttaacacaatactaaactgctaaacaactagatgtaatcaggttatcaaaggcaagtagagtaataaatctctcctgcatggtaaatctagactttttttcccccttgtcctcgtgataagtatgtcaccaatatatgatttaaaccgagcactgatgctggacttcatgatttttaccctccctttggcaaggctttgtctcactgtacggtttaatttggtgatatcttaagcctttcttcccatccttaactgttcaagtatgtctgttgtaaccaataagtttattgctgtgaaattacttctgatggtagagaaggggttctataactgcttttgttttgttttggataaatttcctgttgtgtgggtggcatttttcttaacgagatttgcttctgtcttagcctcacacagggaaaatatccatttatcttctctctcgtgcttaattaatagctttatctttttttataccattttatccttttctctttaacagaaagtaaatatgtataaaatttgaaggaatcgaactaacaatacattctgtgtatattattttaatgaagaaaataaattgattactggcattggaacagtataaaataccagtttgtacagtatgacctatatgtgaccatgttactcccttccatttcacacaaagaaatagacacaactgcagttcacaagtagtactggctccaccccttggtgctggcagtgtttggggacattatgctggaaagagctcctagcatcagaggattaacactagcagattctgttccatctttgcactgttgcttacctgctgattttcttaactgttcttgtgcaatcgacaatgtgctaacctgcttttctctttttgtaaacgtttttgcattacaggctgcattcttgccttactgtatagaaaaagaaaaaaggctgggtttactattgcacattttaagcttttatacctttatcttcttggaatggtcagattctgaactggacagtcagaaccacaggtctgctgttaagggattttaaattgtgcatttttaaccctacagtgaaataacttaagatatccctgtgttcacagtgtgaggggctgttttatgtcatgttggcataaattgttttgtaaaagggaaagtgtttctaaaggtgtttcagcgcttgtgctgatacaaagtaagttattactttgcaccaggtggtttggccactgaattaatactgtatagcaagagaaacaatcttatttttttggacaacatgttttattaagttcttcatttctgttgattttttttattgcatttatgattcagtggctgggaattgagaatttatttgaaatagaataggtaacacctcagcgtactatagaaaatgcactcagctcaactgctgtgtttaaaatacacattttaaatccctctttacagacactaacataaaagtacatctttctgggttgtaaacatgtggtagtaccagagtattgtatagtcaatgttaaataaaagccaaaactggaatgtgcagaaagtaggctttggttaatttgtggattcatttttatttttgtctttgtttaactttttaaaaaataagatttctggagtagattggtatattctgttaaagacttacagtgatccattttgcttacactgttgcatcacaagggactcacccagggaccatgacctgctggtgtgtgtgtatatttacaaaaacaaaacaaacaaaccacccattgggatataaggtagcaatcacaaactaaagactgcggcttgttgaggtgcaataccctgactcccaaagttagttacagtgggttttattgtttttgtgactgaaggatttattcagactgctgtactcttcatttgatgtaacaaaatgctattaatctaaatatttgtaaataaagtacctgtatctagattaaattaaaattggttgcattattttctgaactataatagggtttttcttcaggtgaacaatttgacgtgtcatcagtttttattgcagcactgtccatattcattgtataaagagaggtctacgtatgtagcatataaaaccacatcactaagtaatagacccacagctttattcttgtgtttacattacccttgaaatgttttcagtcaacccttttcagtgtaagatcagcacatttggtggctgatgctgttctcctttgactgtaccgggagccagattctatcatatgcatgtgtaatcccctgtaatacactcaggtgctcacaaatagagcagattgtcatattgtaacatgcgtgtgccagacaccgggcagtacactttggaaagaatgtgaaatccttttaatttttaatccatagcttactgcttgtgcagtcacctgcctcttgaggttgctcattgcccttggacctgtgaggaggccttcagattagtaattggtgcttagtactatttatgcttaaatagatcttccagtacaatgttgaagtcttttttatggataataacgtgtttgatggagtaacttattatttttttttggttggtggtttacacgttaatagaggtagtacaatttctttggaaaggtgtcttttgaagccagctgttaagcttcatacattacctcccttctcaaattcggtaagacagtagttttggggaacttttttgcccatgtgtcttttaagtgtgattttaaaaaaatgagtggttcagttcattcccctaaacagaagaaaagaccaaataattaccttccattcctcttcatgtgggaatatagagagggttcatgtggcattttagagaaaagataatttatcctcattcaacacaggcccagaaaattgtgtcccagaaggatgtcagtaattgtgactaggccaggccttttagcattttgctaagacttgaaacaaaaaatgtaaatacaaaagaaatcaagttttgttttgaaagatgccttctagaacttactgtgtattaataaattgtcactttcattgtctttattgtaactccattgatcccgtatcttaacggttcacgtctagccaaataactgttttggaataaaaaccttggtggtga

SEQ ID NO: 173056 - DNA, 711 bp, Homo sapiens
  Payload ID: 14009
  Gene Symbol: RAB14
  Gene Name: RAB14, member RAS oncogene family
  ENST ID: ENST00000451303
  CDS Start-End: 167-711
acatgcgcccctctcaagtgctggcagaccactgtgcatgcagacaacgcacccaaagggaagaatcaggggaacagtaacgcaaccctgccagcatgccaatgtagaaaacttgaaagaatgaacacaaaaatgtttacaaaggatatcatggcagagtgccaccatggcaactgcaccatacaactactcttacatctttaaatatattattattggggacatgggagtaggaaaatcttgcttgcttcatcaatttacagaaaaaaaatttatggctgattgtcctcacacaattggtgttgaatttggtacaagaataatcgaagttagtggccaaaaaataaaactgcagatttgggatacggcaggacaggagcgatttagggctgttacacggagctactacagaggagctgcgggagctcttatggtctatgatatcactagaagaagtacatataaccacttaagcagctggttgacagatgcaaggaatctcaccaatccaaatactgtaataattctcataggaaataaagcagatttggaggcacagagagatgttacatatgaagaagccaaacagtttgctgaagaaaatggcttattgttcctcgaagcgagtgcaaaaacgggagagaatgtagaagatgccttccttgaggctgccaagaaaatctatcagaacattcaggatggaagcttgga

SEQ ID NO: 173057 - DNA, 1078 bp, Homo sapiens
  Payload ID: 14010
  Gene Symbol: REP15
  Gene Name: RAB15 effector protein
  Uniprot ID: Q6BDI9
  ENST ID: ENST00000310791
  CDS Start-End: 45-755
cgtctgaaccagattcacatgtttgatatttggatgcagagaaaatggggcagaaagcatcgcaacagttggctctgaaggacagcaaagaggtgcccgtcgtctgtgaggtggtcagtgaagctatagtccatgcagctcagaaactgaaggagtaccttggatttgaatatcctccaagtaaactctgcccagctgcaaatactctgaatgagatcttcttaatccatttcatcactttctgccaagaaaagggagttgatgagtggctgaccaccaccaagatgaccaagcaccaagccttcctgtttggtgcagactggatttggaccttttggggatccaacaagcaaataaagcttcagctcgcagtacagactctgcagatgtcttcacctcctcctgtggaatctaagccttgtgacctttccaatccagaatcaagggtagaggagtcttcctggaagaaaagtagatttgataagctggaagaattctgtaacttaataggagaggattgcctgggtctgtttatcatctttggtatgccaggaaagcctaaagacatcaggggagttgtcctggacagtgtcaaaagtcagatggtgaggagccatctgccaggagggaaggctgtggctcagtttgtcctggaaactgaagattgtgtgttcatcaaagagctgctcagaaattgtctgagtaagaaagacgggctgagagaggtgggcaaggtttatatcagcattctctgacttggatatgtattatgtgagtggcctgtaagaggaaaagaaaaaaagattctaataagcaagctcacctatttgcatcattccagcatgggattttttttcatttgttttcccattgattgaaaatgattactgggatcaaagtacattcatgtcgcaattacagagagagagagaaaaaaagaaaaccctggctctgcctatgatttaaaaacagttcaggaaaagttataatttagtttaatatttcattcacttattcaataataaaaatggaagagagataataaagtcacatttaaagtttgatttgcaaaaaaaaa

SEQ ID NO: 173058 - DNA, 3391 bp, Homo sapiens
  Payload ID: 14011
  Gene Symbol: RAB15
  Gene Name: RAB15, member RAS oncogene family
  Uniprot ID: P59190
  ENST ID: ENST00000267512
  CDS Start-End: 82-708
gggcgcgggccgcgatggcagcggcggagcagggctgagcccgctgcccgcccgcagttcccggccccgctggccccagtcatggcgaagcagtacgatgtgctgttccggctgctgctgatcggggactccggggtgggcaagacctgcctgctgtgccgcttcaccgacaacgagttccactcctcgcacatctccaccatcggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgaggtaggagatgccacctcactgccggggtgtggagagggtgcctcaccggggaaggcaaggcgagggccagatgggaaggcaaatgcttccaggaagctttgccttccacagccctggatgaagacctctggtacgcaccagaaggcgtccagaagatccttattgggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccagggagtcctcgagcctggggctgccctacctctacccattccccgaccagagctttgcccttgcttggctgcccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaaccaggctctgctggcctgtttactcgtcaccacctctgcacctgctgtcttgagactccatccagccccaggcacgccacctgctcctgagcctccactatctccctgtgacgggtgaacttcgtgtactgtgtctcgggtccatatatgaattgtgagcagggttcatctattttaaacacagatgtttacaaaataaagattatttcaaaccacc

SEQ ID NO: 173059 - DNA, 683 bp, Homo sapiens
  Payload ID: 14011
  Gene Symbol: RAB15
  Gene Name: RAB15, member RAS oncogene family
  ENST ID: ENST00000426039
  CDS Start-End: 64-564
ctgggcgacagaggaagactccgtcaagaaaaaagagaaaaggcatcaggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgagtacgcaccagaaggcgtccagaagatccttattgggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatca

SEQ ID NO: 173060 - DNA, 3515 bp, Homo sapiens
  Payload ID: 14011
  Gene Symbol: RAB15
  Gene Name: RAB15, member RAS oncogene family
  Uniprot ID: P59190
  ENST ID: ENST00000533601
  CDS Start-End: 339-977
cgcgcgctccccgccccctctctccggggcggcggcggcggcgcaggggaaggggcgggcaggggccgccgccggtttctcctcccaccgcctcgcgccagcccagccgagccgagccgagccgagcgggcgccgcgccgggctcccgccgcagccgcgcttcccggcacccagcgagcgagtgggcaggcgggcgggcgaggcagccgcgggggccgggcccggcgtcctcctcgccgcccgcagcgtccccgggcgggcgcgggccgcgatggcagcggcggagcagggctgagcccgctgcccgcccgcagttcccggccccgctggccccagtcatggcgaagcagtacgatgtgctgttccggctgctgctgatcggggactccggggtgggcaagacctgcctgctgtgccgcttcaccgacaacgagttccactcctcgcacatctccaccatcggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgagtacgcaccagaaggcgtccagaagatccttattgggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccagggagtcctcgagcctggggctgccctacctctacccattccccgaccagagctttgcccttgcttggctgcccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaacagcagggcctcctaggccccatcttccatttcttaggtaagaagagcatttcctcagactcccaggcggaggactgagcctagccttcagcaaccaaggttctcctgggacccaaagtttatgggagaagggcaaagacttcatgggaagagagaaggaaggccctgggtagaaacgcttggtgctgttctctttggcctttaagacaaagcgctcatcttgccctctacctcctgataggcttgagggtttgccaaccacactgtggctacaggtggagggaagaggactccttcctccagagtgctatgttcaggaagtttctttaaccccatatggcccaagagtagctcgtaggaggccctttaaagacggaacaagtaatttaccagttctactggggttcctgcccaccgtcccaaggtgggcgaggcctaggaagagggtcattcttaagccacacattagctgcactgcgtggctgcagccaaaacaaagaactgggtgttgagtattcatcaactaagaaccaaaatccagggcactcatatgtgaaggataagaacctcacttccttactcctccaaaaagaagtggggaaagaaccatcaaacctttcctcctgacttaccaaaccaggaaaacagcaggagagggtggctcaggacttagggacagggtatagcttagatggtggaaagcaaaggagagcaggaagttgtaaatcactggctaatgagaaaaggagacagctaactctaggatgaagctgtgactaggctggagttgcttccttgaagatgggactccttgggtatcaagacctatgccacatcacactggggctagggaagtaggtgatgccagccctcaagtctgtcttcagccagggacttgagaagttatattgggcagtggctccaatctgtggaccagtatttcagctttccctgaagatcaggcagggtgccattcattgtctttctctcctagccccctcaggaaagaaggactatatttgtactgtaccctaggggttctggaagggaaaacatggaatcaggattctatagactgataggccctatccacaagggccatgactgggaaaaggtatgggagcagaaggagaattgggattttagggtgcagctacgctcaccctaaacttttggtggcctggggcatgtcttgaggcccagactgttaaccaggctctgctggcctgtttactcgtcaccacctctgcacctgctgtcttgagactccatccagccccaggcacgccacctgctcctgagcctccactatctccctgtgacgggtgaacttcgtgtactgtgtctcgggtccatatatgaattgtgagcagggttcatctattttaaacacagatgtttacaaaataaagattatttcaaacca

SEQ ID NO: 173061 - DNA, 533 bp, Homo sapiens
  Payload ID: 14011
  Gene Symbol: RAB15
  Gene Name: RAB15, member RAS oncogene family
  ENST ID: ENST00000554593
  CDS Start-End: 82-533
acactctcggggactcatggagacgggtgttcgaatccagatcctgctcaaggccttcctacctcgggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgagtacgcaccagaaggcgtccagaagatccttattgggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggagga

SEQ ID NO: 173062 - DNA, 2209 bp, Homo sapiens
  Payload ID: 14011
  Gene Symbol: RAB15
  Gene Name: RAB15, member RAS oncogene family
  ENST ID: ENST00000585059
  CDS Start-End: 1-422
gcccccgtccccagctggggaggaattgccagcccctccggctggaggcggtggcgccggaggccggagtccgggataaatctcggggtgttgactttaagatgaagaccatagaggtagacggcatcaaagtgcggatacagatctgggacactgcagggcaggagagataccagaccatcacaaagcagtactatcggcgggcccaggggatatttttggtctatgacattagcagcgagcgctcttaccagcacatcatgaagtgggtcagtgacgtggatgaggtaggagatgccacctcactgccggggtgtggagagggtgcctcaccggggaaggcaaggcgagggccagatgggaaggcaaatgcttccaggaagctttgccttccacagccctggatgaagacctctgggtgagtaagacatggggaagaaaccgaagctgccatgccctcactctctataccctgccaggcctccacggctgtgtctttcccggaaatgaattagttccaagtcttccctgtgagcagcttctttcctgaaatcttgggaccaggtggagttgcaagattgggatctagtcctggctctgcacaatagctgtggagccttgggaagccatttgaatcctctgggtccccagttcctgtagaatgagggctggacttacatccaatgtcctttccagctctgataccagtggtctaacccaaggaagcaccagtcttagccagagtgtcttctaccctaagctctccccgtgatacccttgagtacgcaccagaaggcgtccagaagatccttattgggaataaggctgatgaggagcagaaacggcaggtgggaagagagcaagggcagcagctggcgaaggagtatggcatggacttctatgaaacaagtgcctgcaccaacctcaacattaaagagtcattcacgcgtctgacagagctggtgctgcaggcccataggaaggagctggaaggcctccggatgcgtgccagcaatgagttggcactggcagagctggaggaggaggagggcaaacccgagggcccagcgaactcttcgaaaacctgctggtgctgagtcctgtgtggggcaccccacacgacacccctcttccctcaggaggcccgtgggcagacaggggagccggggctttgccctgctgctgtcctctcgtgtgatgaccctattgagtatcagtagccactactccccctgcctggccctgagagcggctctgctgtcatctcaagcagcccctgtccccagcccgtccaccctggagtggtcttcttcagcctgtttccccagccacaggcctgctacgacccccacgatgtgccgcaagcactgtctcaccatcccgcacccaccagacaacagccagggctggagtccaggccactttcagctgctcctttctccgtgcatcgtgtctcttctctgctttttctctcttcccccacttctctttctctgacccctcccctccggtgcgtttcgtatcaaagctcctcaaaccccgtcccccgtgtgtcctgctgtgtgcagctcgctctttccttccttcctaagctatccaaggggatggacccaggctcgtggggaggttccacccttggatccaggaagaaccctccaccctgcctcgtgggtgggccaaaggctacagggtgcttcttcctcttcccccacccccactgtccctcatgtgccatgggcctgcctccccagtgacctgcgaaagtggagcatcgaggtaggagggaaacggcaaccagggagtcctcgagcctggggctgccctacctctacccattccccgaccagagctttgcccttgcttggctgcccgcctgcctctttggggaactgagctcagaggcaggtgcttcagagaaggaaacaaaatgaggggtggcagggataaaaagtcacctccattctctacctcccatgcagcatgaacacaatttctctccacctggctcccaaatttaaagatgtggaccaaggcctgtgggtactccaggggcaaggagagccctggggtcagtgacactgtcaggccaaccatgcactccacaaaggggagcatttggaaatgaaggactagctcctatgtatcaggttaagagcaagggagagctggccagggacagcagtttgcacagcagaggggaatgtagcaa

SEQ ID NO: 173063 - DNA, 1966 bp, Homo sapiens
  Payload ID: 14012
  Gene Symbol: RAB17
  Gene Name: RAB17, member RAS oncogene family
  Uniprot ID: Q9H0T7
  ENST ID: ENST00000264601
  CDS Start-End: 631-1269
actcagttgcctctggccagtgcagggctcagccagggatggcttctagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccggaataaagctgaaaaacgggctccagttgggtgccaggaaatgcaggactggaatgtgacttgacttccggcagcgcgcaggtgctcccgggtcacctgctttgaggtccagcctcctgccctgcctcaggtgaccacatgaccactgtggactttgccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtaagtccagcttggctcttcggtacgtgaagaacgacttcaagagtatcctgcctacggtgggctgtgcgttcttcacaaaggtggtggatgtgggtgccacctctctgaagcttgagatctgggacacagctggccaggagaagtaccacagcgtctgccacctctacttcaggggtgccaacgctgcgcttctggtgtacgacatcaccaggaaggattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccacctggacggtggccccctcagcctggcagcctctggacagagaggaaggaaggattggaaaagtccccgcagcacagcgacggtgggaagatgccttacgtctgatcttgatgggggcactggcctggagcctgggcccacctgcttctggggggttggggagcaggccagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgacaatctg

SEQ ID NO: 173064 - DNA, 1792 bp, Homo sapiens
  Payload ID: 14012
  Gene Symbol: RAB17
  Gene Name: RAB17, member RAS oncogene family
  ENST ID: ENST00000392001
  CDS Start-End: 609-767
cagggctcagccagggatggcttctagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccggaataaagctgaaaaacgggctccagttgggtgccaggaaatgcaggactggaatgtgacttgacttccggcagcgcgcaggtgctcccgggtcacctgctttgaggtccagcctcctgccctgcctcaggtgaccacatgaccactgtggactttgccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtaagtccagcttggctcttcggtacgtgaagaacgacttcaagagtatcctgcctacggtgggctgattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccacctggacggtggccccctcagcctggcagcctctggacagagaggaaggaaggattggaaaagtccccgcagcacagcgacggtgggaagatgccttacgtctgatcttgatgggggcactggcctggagcctgggcccacctgcttctggggggttggggagcaggccagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgacaatctg

SEQ ID NO: 173065 - DNA, 1077 bp, Homo sapiens
  Payload ID: 14012
  Gene Symbol: RAB17
  Gene Name: RAB17, member RAS oncogene family
  Uniprot ID: Q9H0T7
  ENST ID: ENST00000409822
  CDS Start-End: 539-796
agcctcctgccctgcctcaggtgaccacatgaccactgtggactttgccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacaggtgcgttcttcacaaaggtggtggatgtgggtgccacctctctgaagcttgagatctgggacacagctggccaggagaagtaccacagcgtctgccacctctacttcaggggtgccaacgctgcgcttctggtgtacgacatcaccaggaaggattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccacctggacggtggccccctca

SEQ ID NO: 173066 - DNA, 466 bp, Homo sapiens
  Payload ID: 14012
  Gene Symbol: RAB17
  Gene Name: RAB17, member RAS oncogene family
  ENST ID: ENST00000409576
  CDS Start-End: 198-359
gctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttttcctccaaaaattaaattgcttttgaca

SEQ ID NO: 173067 - DNA, 1511 bp, Homo sapiens
  Payload ID: 14012
  Gene Symbol: RAB17
  Gene Name: RAB17, member RAS oncogene family
  ENST ID: ENST00000414278
  CDS Start-End: 253-417
ggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtaagtccagcttggctcttcggtgcgttcttcacaaaggtggtggatgtgggtgccacctctctgaagcttgagatctgggacacagctggccaggagaagtaccacagcgtctgccacctctacttcaggggtgccaacgctgcgcttctggtgtacgacatcaccaggaaggattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacagccagaagttgctgttcatggaaacttcggccaaactgaaccaccaggtgtcggaggtgttcaatacagtggcccaagagctactgcagagaagcgacgaggagggccaggctctacggggggatgcagctgtggctctgaacaaggggcccgcgaggcaggccaaatgctgcgcccactaggtgcagccactcctgggggctgtggggaagacaccccctgcctgggccatggccagctctaggtggattctgattcactgtcaatgctgggttgctcccgagccctagatgttcctggaagttggccccctttatgaaaaccacttcccacagccagtgggaactgccagaggaagatctggcgtcacatggctcccaggaaagtgctgtgccctatccccactgataccatctgattccccgatgcctgtgcctgttccacctggacggtggccccctcagcctggcagcctctggacagagaggaaggaaggattggaaaagtccccgcagcacagcgacggtgggaagatgccttacgtctgatcttgatgggggcactggcctggagcctgggcccacctgcttctggggggttggggagcaggccagatggaggtggtggtgccaggaagaaatggagcgatgactgactgtggggtgggcccaggatttccacatcttggtgaagttgcccctgggaagggcagctgggggcagtggcgccagttcccttccatggtctcccggctggcaatgtggtgaagctgagtttctgtccaatgagcaggaagattctgagacatttcgcctgagatataagttgtactgcgtatgcagtttt

SEQ ID NO: 173068 - DNA, 663 bp, Homo sapiens
  Payload ID: 14012
  Gene Symbol: RAB17
  Gene Name: RAB17, member RAS oncogene family
  ENST ID: ENST00000411462
  CDS Start-End: 272-663
gccctgaaaccttctgggaggagaagaggcctgaccttggcgctggggtccagtgggcattgctctggtccgaggctgctgctcttgacctctgctctgcggctgttttccattggagtagaggctcctcctgtcctgtcctgcctgtggagggaagcaaaccttcccctggaccagagagaggagaaagcggagacaggtagcaacgctgtggactggtgatgacaggctcttcagctccctgcaagtgaccgggcctggggaacagggcatggcacaggcacacaggaccccccagcccagggctgcccccagccagccccgtgtgttcaagctggttctcctgggaagtggctccgtgggtgcgttcttcacaaaggtggtggatgtgggtgccacctctctgaagcttgagatctgggacacagctggccaggagaagtaccacagcgtctgccacctctacttcaggggtgccaacgctgcgcttctggtgtacgacatcaccaggaaggattccttcctcaaggctcagcagtggctgaaggacctggaggaggagctgcacccaggagaagtcctggtgatgctggtgggcaacaagacggacctcagccaggagcgggaggtgaccttccaggaagggaaggagtttgccgacag

SEQ ID NO: 173069 - DNA, 421 bp, Homo sapiens
  Payload ID: 14012
  Gene Symbol: RAB17
  Gene Name: RAB17, member RAS oncogene family
  ENST ID: ENST00000430445
  CDS Start-End: 1-421
tgttcaagctggttctcctgggaagtggctccgtgggtgcgttcttcacaaaggtggtggatgtgggtgccacctctctgaagcttgagatctgggacacagctggccaggagaagtaccacagcgtctgccacctctacttcaggggtgccaacgctgcgcttctggtgtacgacatcaccaggaaggattccttcctcaaggctcagcagtggctgaaggacctggaggaggagctgcacccaggagaagtcctggtgatgctggtgggcaacaagacggacctcagccaggagcgggaggtgaccttccaggacgaagaccgtgtaaacagctgcagacaagtggctgatggggagaccccacacacactagaggctggcgcaggggaagacccaactcagggcttagaccgacgggc

SEQ ID NO: 173070 - DNA, 4886 bp, Homo sapiens
  Payload ID: 14013
  Gene Symbol: RAB18
  Gene Name: RAB18, member RAS oncogene family
  Uniprot ID: Q9NP72
  ENST ID: ENST00000356940
  CDS Start-End: 103-723
tggcagacgtggagcggcgcgcatgcgcagcagctcactctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctagatgcatttgtgtaggaagtatatacatttccctattactctcatcagctgaagaatatgtactattgtgttactcaaattatgtggctttcattttgttgttttgttgcaagcttagtgttttgtagtggaggttttgtaaatgaaacagttgtaatatctaaggtcaggcacctagtaacagggttttgttaattcttttcagaatcattgaagcagtcttaaagggtcttttgcagatggtacaaattagaacaattagaatatagtattttgagttctagtagtactgagattgacccaaacaaataaaaaactattcaatttctgagtaatagttaatatttattgaaagcttccttggtgccagatgcctttctaagtgctgaattatctcattaaacctcacagcaaccttaagagattagtactcctattatgcccattttaaaggtgaggacaacacaatgtaggtatgttaggtaacccccaaagatcacatagctactcagtcactgagctggattccagtcatggcatttttacttctgagcccatactcttcaccatcgctcattttacaatgggtagttagttaccagctttttgtaacacaaccaagttaaggcagttccactatttctttatcactcttttgttatatgtaatagaagtatttcacacttttgggttatagagtaaatcccatgatgtaaacctacctcataagtcatgtgacataaaagttaaggtagtggagtaggtggtcttatttctttcacctgctcagagtggactgaaaatcctgacttagaaaaggtacaaagttaggggacttatggtaccttcactttttatgtgagaatagaaattatggaaacagtaatttgctcaaaactgaaatctggggtgatgttttcatttcatgtatttgattgccatccataaactcatacttggtgttgacattctagctgagtgttgtggaaatagacttgattttgattcatcgtagcttgcatggtcaagagacatgattctctactaagggtggggctagcaccatagctcataaaagaatccttcttacaccagtacttgttctgcctgtgagttggcacagacttacctaataaccatagtgtctttaagtacaacttaatacatattttttctgtgtatttttttcaaatgaactcaacaattcttcaggtattatagatcagagatcctctccatattcaagcattatgcttctctttcttgggggtacatttcactagtaatacttaggaagttattttgtctttcctgtatttccctagttaagtataggggtaaaaacgttattcagctttcagaagacattgttctgactccgaccctgccgtgtatactcaactatatagacttcaccctgggttttgcctaaactgttgaaagacgagaataaatagacatagacaggctagctaagtcaagactaggggctaaggaatatagaatcacccaggtctttttttttttttttaatttttctctcctcagttgggaacatctatcatgctggaggactactgtgatggggctttacattttactgttttgttgctagcttattgtttcatacttgggaatcagtcatgtttctgattgtggtataaagtttgcttaagtgccccttagttaaagctgttcaatgaatgtaagcacacacacacctacacacatattttgaatagtcgtgtgttcatgcctgttctcagtcttgtcccctttaccgtttctcatgcaggttatttcttgctttttttttttttcctcttttttaaccggagaagcaacaaattacgtagttttttttgtgtttctttgattactagtgagcttgagtacttttaatattttattggatatgtttgtgactgactttaatttcttgtttgtgtgtgctgtggctgcccgatccagcacctacttccttctcccaccataccacccccacccccacccctgcaaacaattggcatgtggtttgggtggcattgtcacaccctcggctttctagattaacccagttaccttttagcagtgccccacttccccagtagcaatggttcaggggtaggcacctgacccagaccagactactgagataaagatgtttgcctaggctttttcaggagcaattgaagacatcttgttggagatagtgtgctgggaggagtcacattctgaacttgctgcagctcgtttttctaatataaaggaaccagcctgaggcagtaccagggtgagagggagtctattggagcccttgggaacttctggatcaaattggacctgaattgagatctatttctcagctttcacttatgtgagccaa

SEQ ID NO: 173071 - DNA, 617 bp, Homo sapiens
  Payload ID: 14013
  Gene Symbol: RAB18
  Gene Name: RAB18, member RAS oncogene family
  ENST ID: ENST00000375802
  CDS Start-End: 43-528
cacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaatagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttg

SEQ ID NO: 173072 - DNA, 873 bp, Homo sapiens
  Payload ID: 14013
  Gene Symbol: RAB18
  Gene Name: RAB18, member RAS oncogene family
  ENST ID: ENST00000423465
  CDS Start-End: 1-873
gcgcctgcctggttcccggcctttgccaggcccaagttctctgggtcgctctccctcctgtagcgccgagaaaacaccattccgagggccgccgctcggccggcagtcggctgtgaaagaactggatcttgtgactgctggaaaatttcgctttagtgtaaggtccgagtgcttcagccgtgggccacctttgaaaataaaatgtaattgttatttctcattttgccacatcctgtggagacagaagattagtgttgtgctttcattttttactttttccttggggaaaataatattgacagtggagttgagtataagcctgctcttgaggttcacagatgatacgtttgatccagaacttgcagcaacaataggtgttgactttaaggtgaaaacaatttcagtggatggaaataaggctaaacttgcaatatgggttactttgcatcagcagactgcaaactttttcttaaagagccagataggaaatagtccaatcctgaagtgggccatgtggcaatacgatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtga

SEQ ID NO: 173073 - DNA, 4811 bp, Homo sapiens
  Payload ID: 14013
  Gene Symbol: RAB18
  Gene Name: RAB18, member RAS oncogene family
  Uniprot ID: Q9NP72
  ENST ID: ENST00000535776
  CDS Start-End: 197-625
ggggattctgggtcgcgcagccgtggagctacctcaaggcggaactggggagtccagggcttcggcagcctgaacacccggtgtgaaaggaaggtggcagacgtggagcggcgcgcatgcgcagcagctcactctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctagatgcatttgtgtaggaagtatatacatttccctattactctcatcagctgaagaatatgtactattgtgttactcaaattatgtggctttcattttgttgttttgttgcaagcttagtgttttgtagtggaggttttgtaaatgaaacagttgtaatatctaaggtcaggcacctagtaacagggttttgttaattcttttcagaatcattgaagcagtcttaaagggtcttttgcagatggtacaaattagaacaattagaatatagtattttgagttctagtagtactgagattgacccaaacaaataaaaaactattcaatttctgagtaatagttaatatttattgaaagcttccttggtgccagatgcctttctaagtgctgaattatctcattaaacctcacagcaaccttaagagattagtactcctattatgcccattttaaaggtgaggacaacacaatgtaggtatgttaggtaacccccaaagatcacatagctactcagtcactgagctggattccagtcatggcatttttacttctgagcccatactcttcaccatcgctcattttacaatgggtagttagttaccagctttttgtaacacaaccaagttaaggcagttccactatttctttatcactcttttgttatatgtaatagaagtatttcacacttttgggttatagagtaaatcccatgatgtaaacctacctcataagtcatgtgacataaaagttaaggtagtggagtaggtggtcttatttctttcacctgctcagagtggactgaaaatcctgacttagaaaaggtacaaagttaggggacttatggtaccttcactttttatgtgagaatagaaattatggaaacagtaatttgctcaaaactgaaatctggggtgatgttttcatttcatgtatttgattgccatccataaactcatacttggtgttgacattctagctgagtgttgtggaaatagacttgattttgattcatcgtagcttgcatggtcaagagacatgattctctactaagggtggggctagcaccatagctcataaaagaatccttcttacaccagtacttgttctgcctgtgagttggcacagacttacctaataaccatagtgtctttaagtacaacttaatacatattttttctgtgtatttttttcaaatgaactcaacaattcttcaggtattatagatcagagatcctctccatattcaagcattatgcttctctttcttgggggtacatttcactagtaatacttaggaagttattttgtctttcctgtatttccctagttaagtataggggtaaaaacgttattcagctttcagaagacattgttctgactccgaccctgccgtgtatactcaactatatagacttcaccctgggttttgcctaaactgttgaaagacgagaataaatagacatagacaggctagctaagtcaagactaggggctaaggaatatagaatcacccaggtctttttttttttttttaatttttctctcctcagttgggaacatctatcatgctggaggactactgtgatggggctttacattttactgttttgttgctagcttattgtttcatacttgggaatcagtcatgtttctgattgtggtataaagtttgcttaagtgccccttagttaaagctgttcaatgaatgtaagcacacacacacctacacacatattttgaatagtcgtgtgttcatgcctgttctcagtcttgtcccctttaccgtttctcatgcaggttatttcttgctttttttttttttcctcttttttaaccggagaagcaacaaattacgtagttttttttgtgtttctttgattactagtgagcttgagtacttttaatattttattggatatgtttgtgactgactttaatttcttgtttgtgtgtgctgtggctgcccgatccagcacctacttccttctcccaccataccacccccacccccacccctgcaaacaattggcatgtggtttgggtggcattgtcacaccctcggctttctagattaacccagttaccttttagcagtgccccacttccccagtagcaatggttcaggggtaggcacctgacccagaccagactactgagataaagatgtttgcctaggctttttcaggagcaattgaagacatcttgttggagatagtgtgctgggaggagtcacattctgaacttgctgcagctcgtttttctaatataaaggaaccagcctgaggcagtaccagggtgagagggagtctattggagcccttgggaacttctggatcaaattggacctgaattgagatctatttctcagctttcacttatgtgagccaataaattccttttttgttgaaggc

SEQ ID NO: 173074 - DNA, 4894 bp, Homo sapiens
  Payload ID: 14013
  Gene Symbol: RAB18
  Gene Name: RAB18, member RAS oncogene family
  Uniprot ID: Q9NP72
  ENST ID: ENST00000621805
  CDS Start-End: 1-708
atggacgaggacgtgctaaccaccctgaagatcctcatcatcggcgagagtggggtgggcaagtccagcctgctcttgaggttcacagatgatacgtttgatccagaacttgcagcaacaataggtgttgactttaaggtgaaaacaatttcagtggatggaaataaggctaaacttgcaatatgggttactttgcatcagcagactgcaaactttttcttaaagagccagataggaaatagtccaatcctgaagtgggccatgtggcaatacgatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctagatgcatttgtgtaggaagtatatacatttccctattactctcatcagctgaagaatatgtactattgtgttactcaaattatgtggctttcattttgttgttttgttgcaagcttagtgttttgtagtggaggttttgtaaatgaaacagttgtaatatctaaggtcaggcacctagtaacagggttttgttaattcttttcagaatcattgaagcagtcttaaagggtcttttgcagatggtacaaattagaacaattagaatatagtattttgagttctagtagtactgagattgacccaaacaaataaaaaactattcaatttctgagtaatagttaatatttattgaaagcttccttggtgccagatgcctttctaagtgctgaattatctcattaaacctcacagcaaccttaagagattagtactcctattatgcccattttaaaggtgaggacaacacaatgtaggtatgttaggtaacccccaaagatcacatagctactcagtcactgagctggattccagtcatggcatttttacttctgagcccatactcttcaccatcgctcattttacaatgggtagttagttaccagctttttgtaacacaaccaagttaaggcagttccactatttctttatcactcttttgttatatgtaatagaagtatttcacacttttgggttatagagtaaatcccatgatgtaaacctacctcataagtcatgtgacataaaagttaaggtagtggagtaggtggtcttatttctttcacctgctcagagtggactgaaaatcctgacttagaaaaggtacaaagttaggggacttatggtaccttcactttttatgtgagaatagaaattatggaaacagtaatttgctcaaaactgaaatctggggtgatgttttcatttcatgtatttgattgccatccataaactcatacttggtgttgacattctagctgagtgttgtggaaatagacttgattttgattcatcgtagcttgcatggtcaagagacatgattctctactaagggtggggctagcaccatagctcataaaagaatccttcttacaccagtacttgttctgcctgtgagttggcacagacttacctaataaccatagtgtctttaagtacaacttaatacatattttttctgtgtatttttttcaaatgaactcaacaattcttcaggtattatagatcagagatcctctccatattcaagcattatgcttctctttcttgggggtacatttcactagtaatacttaggaagttattttgtctttcctgtatttccctagttaagtataggggtaaaaacgttattcagctttcagaagacattgttctgactccgaccctgccgtgtatactcaactatatagacttcaccctgggttttgcctaaactgttgaaagacgagaataaatagacatagacaggctagctaagtcaagactaggggctaaggaatatagaatcacccaggtctttttttttttttttaatttttctctcctcagttgggaacatctatcatgctggaggactactgtgatggggctttacattttactgttttgttgctagcttattgtttcatacttgggaatcagtcatgtttctgattgtggtataaagtttgcttaagtgccccttagttaaagctgttcaatgaatgtaagcacacacacacctacacacatattttgaatagtcgtgtgttcatgcctgttctcagtcttgtcccctttaccgtttctcatgcaggttatttcttgctttttttttttttcctcttttttaaccggagaagcaacaaattacgtagttttttttgtgtttctttgattactagtgagcttgagtacttttaatattttattggatatgtttgtgactgactttaatttcttgtttgtgtgtgctgtggctgcccgatccagcacctacttccttctcccaccataccacccccacccccacccctgcaaacaattggcatgtggtttgggtggcattgtcacaccctcggctttctagattaacccagttaccttttagcagtgccccacttccccagtagcaatggttcaggggtaggcacctgacccagaccagactactgagataaagatgtttgcctaggctttttcaggagcaattgaagacatcttgttggagatagtgtgctgggaggagtcacattctgaacttgctgcagctcgtttttctaatataaaggaaccagcctgaggcagtaccagggtgagagggagtctattggagcccttgggaacttctggatcaaattggacctgaattgagatctatttctcagctttcacttatgtgagccaataaattccttttttgttgaaggc

SEQ ID NO: 173075 - DNA, 4931 bp, Homo sapiens
  Payload ID: 14013
  Gene Symbol: RAB18
  Gene Name: RAB18, member RAS oncogene family
  ENST ID: ENST00000611151
  CDS Start-End: 197-745
ggggattctgggtcgcgcagccgtggagctacctcaaggcggaactggggagtccagggcttcggcagcctgaacacccggtgtgaaaggaaggtggcagacgtggagcggcgcgcatgcgcagcagctcactctgctgaagggctgagaggcgcacccgggcggccagctgggctcggagcggaacggggtcaggatggacgaggacgtgctaaccaccctgaagatcctcatcatcggcgagagtggggtgggcaagtccagcctgctcttgaggttcacagatgatacgtttgatccagaacttgcagatactgctggtcaagagaggtttagaacattaactcccagctattatagaggtgcacagggtgttatattagtttatgatgtcacaagaagagatacatttgttaaactggataattggttaaatgaattggaaacatactgtacaagaaatgacatagtaaacatgctagttggaaataaaatcgataaggaaaatcgtgaagtcgatagaaatgaaggcctgaaatttgcacgaaagcattccatgttatttatagaggcaagtgcaaaaacctgtgatggtgtacaatgtgcctttgaagaacttgttgaaaagatcattcagacccctggactgtgggaaagtgagaaccagaataaaggagtcaaactgtcacacagggaagaaggccaaggaggaggagcctgtggtggttattgctctgtgttataaactctgggaaattccatctcttgcatatttgatcagatagtgacatctttctgtatataaactctttaactgctattttagggaccttgcagtttgcacataattgttttatatcatagcagtaaatatttgcaagaaatcccactcatcgaccccgggtaaaatgttatggtaagcatgcacagtttgcagtctacagtttttttatgtagcacaaaataggtgtacctttataagtacattcaattttatgatttacatttatcatgtaatttttaaaaaaatccatctatctaggatatgttgatacaaagtctgcttttgctattctttttgcttaaatactcctatcattttctgaattacttggtatttagaactcctagcaccacggggaagaatagaggtatcatcaaacgtggcaaattttctttcaggaataataaagagcatgattccacagcttttctgggatgtttgagattcttttttagtactaagcaaaattctcatcacagaatgtagcccaggccaatttataactaaatctctatttgttcggatgatgcttctaaaacagcattgataggttaaagaagcttggtatttttaatttacttcaatgattagctcagttgcttaactggagttttaatcctgtgatatgtacattggattcatgactgtgcagcatttttagttatgtggtgtttggcagaatgacaataaggttttcccccattttggtttcaggaggacatgaatagtgtgtttattgtaactcctcatacacttttaaaaccaacatcttttttcataaatgttggtagtgtttgtccaggtaccttaactgtagcttgtgtaatgttgatgaatatctgtatcttacggcttccataatggctagttgatattcaaaaacctatttctgtgttttgaggggtggggaaaaaaaacactaagtgataatttgaaaaaggcatattgcttccagattctgatgtgtgagggaaaatactgtcacaatgaaaatcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctagatgcatttgtgtaggaagtatatacatttccctattactctcatcagctgaagaatatgtactattgtgttactcaaattatgtggctttcattttgttgttttgttgcaagcttagtgttttgtagtggaggttttgtaaatgaaacagttgtaatatctaaggtcaggcacctagtaacagggttttgttaattcttttcagaatcattgaagcagtcttaaagggtcttttgcagatggtacaaattagaacaattagaatatagtattttgagttctagtagtactgagattgacccaaacaaataaaaaactattcaatttctgagtaatagttaatatttattgaaagcttccttggtgccagatgcctttctaagtgctgaattatctcattaaacctcacagcaaccttaagagattagtactcctattatgcccattttaaaggtgaggacaacacaatgtaggtatgttaggtaacccccaaagatcacatagctactcagtcactgagctggattccagtcatggcatttttacttctgagcccatactcttcaccatcgctcattttacaatgggtagttagttaccagctttttgtaacacaaccaagttaaggcagttccactatttctttatcactcttttgttatatgtaatagaagtatttcacacttttgggttatagagtaaatcccatgatgtaaacctacctcataagtcatgtgacataaaagttaaggtagtggagtaggtggtcttatttctttcacctgctcagagtggactgaaaatcctgacttagaaaaggtacaaagttaggggacttatggtaccttcactttttatgtgagaatagaaattatggaaacagtaatttgctcaaaactgaaatctggggtgatgttttcatttcatgtatttgattgccatccataaactcatacttggtgttgacattctagctgagtgttgtggaaatagacttgattttgattcatcgtagcttgcatggtcaagagacatgattctctactaagggtggggctagcaccatagctcataaaagaatccttcttacaccagtacttgttctgcctgtgagttggcacagacttacctaataaccatagtgtctttaagtacaacttaatacatattttttctgtgtatttttttcaaatgaactcaacaattcttcaggtattatagatcagagatcctctccatattcaagcattatgcttctctttcttgggggtacatttcactagtaatacttaggaagttattttgtctttcctgtatttccctagttaagtataggggtaaaaacgttattcagctttcagaagacattgttctgactccgaccctgccgtgtatactcaactatatagacttcaccctgggttttgcctaaactgttgaaagacgagaataaatagacatagacaggctagctaagtcaagactaggggctaaggaatatagaatcacccaggtctttttttttttttttaatttttctctcctcagttgggaacatctatcatgctggaggactactgtgatggggctttacattttactgttttgttgctagcttattgtttcatacttgggaatcagtcatgtttctgattgtggtataaagtttgcttaagtgccccttagttaaagctgttcaatgaatgtaagcacacacacacctacacacatattttgaatagtcgtgtgttcatgcctgttctcagtcttgtcccctttaccgtttctcatgcaggttatttcttgctttttttttttttcctcttttttaaccggagaagcaacaaattacgtagttttttttgtgtttctttgattactagtgagcttgagtacttttaatattttattggatatgtttgtgactgactttaatttcttgtttgtgtgtgctgtggctgcccgatccagcacctacttccttctcccaccataccacccccacccccacccctgcaaacaattggcatgtggtttgggtggcattgtcacaccctcggctttctagattaacccagttaccttttagcagtgccccacttccccagtagcaatggttcaggggtaggcacctgacccagaccagactactgagataaagatgtttgcctaggctttttcaggagcaattgaagacatcttgttggagatagtgtgctgggaggagtcacattctgaacttgctgcagctcgtttttctaatataaaggaaccagcctgaggcagtaccagggtgagagggagtctattggagcccttgggaacttctggatcaaattggacctgaattgagatctatttctcagctttcacttatgtgagccaataaattccttttttgttgaaggc

SEQ ID NO: 173076 - DNA, 822 bp, Homo sapiens
  Payload ID: 14014
  Gene Symbol: RAB19
  Gene Name: RAB19, member RAS oncogene family
  Uniprot ID: A4D1S5
  ENST ID: ENST00000356407
  CDS Start-End: 69-722
ctggatccccagttcctggtgctgaattccatcctttcttcctagttctgttctaggtggcaagaaccatgcacttctccagctcagccagggcagcagatgagaactttgactatttgttcaagattatcctcattggggattccaatgtggggaagacgtgtgtggtgcagcatttcaagtctggagtctacactgagacacagcagaacacgattggagtggactttaccgtgcgttcccttgatattgacggcaaaaaagtgaagatgcaggtgtgggacacagctggccaggagcgcttccgcaccatcacccaaagctactaccgcagtgcccacgcagccatcatcgcctatgacctcacccggcggtccacgttcgagtccatccctcactggattcatgagatagagaaatatggagctgcaaatgtggtcattatgctgattggaaataaatgtgacctctgggaaaagcggcacgtcctgttcgaggatgcctgcacactggctgagaagtacggcctcctggccgttttggagacatctgccaaggagtcaaagaacatagaagaagtcttcgtgctcatggccaaggagctgatcgcgcgcaacagcctgcacctatatggggagagtgccctgaacggcctccccctggactccagccccgttcttatggcccagggtccaagtgaaaagacccactgcacttgctaagatgtttgcaaagccagttgcacccaccaaagaggccgcctctgaaaccaaaggtagccaggataccgtagtgttgccccagtggcgctttagaccccag

SEQ ID NO: 173077 - DNA, 645 bp, Homo sapiens
  Payload ID: 14014
  Gene Symbol: RAB19
  Gene Name: RAB19, member RAS oncogene family
  ENST ID: ENST00000495590
  CDS Start-End: 199-645
ttgcactttcctttcactttctcaggacgccaaacccgacacctggggccagaactacacttcccaccaagcagcgaggcaggaggaagaagggggcactggggggctgaaaagcaaacccagaagaaagcgaaaacattacctgctgaccagcagaggtgagagagcgagacagttctgttctaggtggcaagaaccatgcacttctccagctcagccagggcagcagatgagaactttgactatttgttcaagattatcctcattggggattccaatgtggggaagacgtgtgtggtgcagcatttcaagtctggagtctacactgagacacagcagaacacgattggagtggactttaccgtgcgttcccttgatattgacggcaaaaaagtgaagatgcaggtgtgggacacagctggccaggagcgcttccgcaccatcacccaaagctactaccgcagtgcccacgcagccatcatcgcctatgacctcacccggcggtccacgttcgagtccatccctcactggattcatgagatagagaaatatggagctgcaaatgtggtcattatgctgattggaaataaatgtgacctctgggaaaagcggcacgtcctgttcgaggatgcctgcacactggct

SEQ ID NO: 173078 - DNA, 952 bp, Homo sapiens
  Payload ID: 14014
  Gene Symbol: RAB19
  Gene Name: RAB19, member RAS oncogene family
  Uniprot ID: A4D1S5
  ENST ID: ENST00000537763
  CDS Start-End: 199-852
ttgcactttcctttcactttctcaggacgccaaacccgacacctggggccagaactacacttcccaccaagcagcgaggcaggaggaagaagggggcactggggggctgaaaagcaaacccagaagaaagcgaaaacattacctgctgaccagcagaggtgagagagcgagacagttctgttctaggtggcaagaaccatgcacttctccagctcagccagggcagcagatgagaactttgactatttgttcaagattatcctcattggggattccaatgtggggaagacgtgtgtggtgcagcatttcaagtctggagtctacactgagacacagcagaacacgattggagtggactttaccgtgcgttcccttgatattgacggcaaaaaagtgaagatgcaggtgtgggacacagctggccaggagcgcttccgcaccatcacccaaagctactaccgcagtgcccacgcagccatcatcgcctatgacctcacccggcggtccacgttcgagtccatccctcactggattcatgagatagagaaatatggagctgcaaatgtggtcattatgctgattggaaataaatgtgacctctgggaaaagcggcacgtcctgttcgaggatgcctgcacactggctgagaagtacggcctcctggccgttttggagacatctgccaaggagtcaaagaacatagaagaagtcttcgtgctcatggccaaggagctgatcgcgcgcaacagcctgcacctatatggggagagtgccctgaacggcctccccctggactccagccccgttcttatggcccagggtccaagtgaaaagacccactgcacttgctaagatgtttgcaaagccagttgcacccaccaaagaggccgcctctgaaaccaaaggtagccaggataccgtagtgttgccccagtggcgctttagaccccag

SEQ ID NO: 173079 - DNA, 1198 bp, Homo sapiens
  Payload ID: 14015
  Gene Symbol: RAB1A
  Gene Name: RAB1A, member RAS oncogene family
  Uniprot ID: P62820
  ENST ID: ENST00000398529
  CDS Start-End: 187-576
gggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatagaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaatatcaaa

SEQ ID NO: 173080 - DNA, 2254 bp, Homo sapiens
  Payload ID: 14015
  Gene Symbol: RAB1A
  Gene Name: RAB1A, member RAS oncogene family
  Uniprot ID: P62820
  ENST ID: ENST00000409892
  CDS Start-End: 191-616
ttttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaatatcaaactgtatggtgataagtattgttttgattcttatggttaaagggaaatagagccttgcattatattcaacacagccatttgtgtgtgcacaatgcaaactaaggtattctagacctatcttagagcagcatccagtatttgctttctagataatatgcccaataacatgacctagaggggcttctgtgctgtgtagggatttaaccaacttcagtggttcagggagctcaaactatatgtaaaacaagtttagaatgtatgctatctagcccgttatctctgatccttctctaaaaccatttgaaatagcttcattgatcaacatttcataaatgcatctgtggtagaggtagaaagcagcacctttcctaattggcaaatgatcagactaatgtgtgctaatgtttttcttccatgctttcagtcagattcaactattttatcctccacagttgcttaacttggtgttggaggagggtttaagcattaagataggaagcaggaaatttgattgctctaaatttagaaattatatccctaaaaattaaaacatgaatactgggtggtaatgataattgaggcaaatgtatttattttggtgacattttgcatatatgaagattttctgaaataggaccttcaagatcctagggggttttgtttggtttttaattgtgaggaataaaaaatcttctgcccacactggcattttaaggtgactgaggtcaaacgttgtttccttaggttgaaatagcagccaaaacattcttcacgcaggggcttgggatatggctgctggcaacacattttgttgtgggctccttaatttaatgataaaatttaagctaaacacaagccaaaaatgaataggtttttttaatttttatttttcactaaacaggcaattgaaatacatggtacaaaaataagtggtaagataattgtaaaatgaaatggacagaatattcaattttccatctatgaaaatttcacaataaaaatcatagtttactttgt

SEQ ID NO: 173081 - DNA, 1333 bp, Homo sapiens
  Payload ID: 14015
  Gene Symbol: RAB1A
  Gene Name: RAB1A, member RAS oncogene family
  ENST ID: ENST00000409751
  CDS Start-End: 190-711
tttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaatatcaaa

SEQ ID NO: 173082 - DNA, 2447 bp, Homo sapiens
  Payload ID: 14015
  Gene Symbol: RAB1A
  Gene Name: RAB1A, member RAS oncogene family
  Uniprot ID: P62820
  ENST ID: ENST00000409784
  CDS Start-End: 192-809
attttgggtggaagcgatagctgagtggcggcggctgctgattgtgttctaggggacggagtaggggaagacgtttgctctcccggaacagcctatctcattcctttctttcgattacccgtggcgcggagagtcagggcggcggctgcggcagcaagggcggcggtggcggcggcggcagctgcagtgacatgtccagcatgaatcccgaatatgattatttattcaagttacttctgattggcgactcaggggttggaaagtcttgccttcttcttaggtttgcagatgatacatatacagaaagctacatcagcacaattggtgtggatttcaaaataagaactatagagttagacgggaaaacaatcaagcttcaaatatgggacacagcaggccaggaaagatttcgaacaatcacctccagttattacagaggagcccatggcatcatagttgtgtatgatgtgacagatcaggagtccttcaataatgttaaacagtggctgcaggaaatagatcgttatgccagtgaaaatgtcaacaaattgttggtagggaacaaatgtgatctgaccacaaagaaagtagtagactacacaacagcgaaggaatttgctgattcccttggaattccgtttttggaaaccagtgctaagaatgcaacgaatgtagaacagtctttcatgacgatggcagctgagattaaaaagcgaatgggtcccggagcaacagctggtggtgctgagaagtccaatgttaaaattcagagcactccagtcaagcagtcaggtggaggttgctgctaaaatttgcctccatccttttctcacagcaatgaatttgcaatctgaacccaagtgaaaaaacaaaattgcctgaattgtactgtatgtagctgcactacaacagattcttaccgtctccacaaaggtcagagattgtaaatggtcaatactgactttttttttattcccttgactcaagacagctaacttcattttcagaactgttttaaacctttgtgtgctggtttataaaataatgtgtgtaatccttgttgctttcctgataccagactgtttcccgtggttggttagaatatattttgttttgatgtttatattggcatgtttagatgtcaggtttagtcttctgaagatgaagttcagccattttgtatcaaacagcacaagcagtgtctgtcactttccatgcataaagtttagtgagatgttatatgtaagatctgatttgctagttcttccttgtagagttataaatggaaagattacactatctgattaatagtttcttcatactctgcatataatttgtggctgcagaatattgtaatttgttgcacactatgtaacaaaacaactgaagatatgtttaataaatattgtacttattggaagtaatatcaaactgtatggtgataagtattgttttgattcttatggttaaagggaaatagagccttgcattatattcaacacagccatttgtgtgtgcacaatgcaaactaaggtattctagacctatcttagagcagcatccagtatttgctttctagataatatgcccaataacatgacctagaggggcttctgtgctgtgtagggatttaaccaacttcagtggttcagggagctcaaactatatgtaaaacaagtttagaatgtatgctatctagcccgttatctctgatccttctctaaaaccatttgaaatagcttcattgatcaacatttcataaatgcatctgtggtagaggtagaaagcagcacctttcctaattggcaaatgatcagactaatgtgtgctaatgtttttcttccatgctttcagtcagattcaactattttatcctccacagttgcttaacttggtgttggaggagggtttaagcattaagataggaagcaggaaatttgattgctctaaatttagaaattatatccctaaaaattaaaacatgaatactgggtggtaatgataattgaggcaaatgtatttattttggtgacattttgcatatatgaagattttctgaaataggaccttcaagatcctagggggttttgtttggtttttaattgtgaggaataaaaaatcttctgcccacactggcattttaaggtgactgaggtcaaacgttgtttccttaggttgaaatagcagccaaaacattcttcacgcaggggcttgggatatggctgctggcaacacattttgttgtgggctccttaatttaatgataaaatttaagctaaacacaagccaaaaatgaataggtttttttaatttttatttttcactaaacaggcaattgaaatacatggtacaaaaataagtggtaagataattgtaaaatgaaatggacagaatattcaattttccatctatgaaaatttcacaataaaaatcatagtttactttgt

SEQ ID NO: 173083 - DNA, 2007 bp, Homo sapiens
  Payload ID: 14016
  Gene Symbol: RAB1B
  Gene Name: RAB1B, member RAS oncogene family
  Uniprot ID: Q9H0U4
  ENST ID: ENST00000311481
  CDS Start-End: 148-753
ccgggaatcagcgcggcgaggcctgagaagaagacgtttgcgcctgcgcgtcgcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaa

SEQ ID NO: 173084 - DNA, 991 bp, Homo sapiens
  Payload ID: 14016
  Gene Symbol: RAB1B
  Gene Name: RAB1B, member RAS oncogene family
  ENST ID: ENST00000527397
  CDS Start-End: 91-600
cggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatcgaatcctacgccaacgtgaagcagtggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctcccc

SEQ ID NO: 173085 - DNA, 1954 bp, Homo sapiens
  Payload ID: 14016
  Gene Symbol: RAB1B
  Gene Name: RAB1B, member RAS oncogene family
  ENST ID: ENST00000615245
  CDS Start-End: 96-584
gcgggcggggcctctggggcggagcggccaccatcttggaacgggaggcggagcagagtcgactgggagcgaccgagcgggccgccgccgccgccatgaaccccgaatatgactacctgtttaagctgcttttgattggcgactcaggcgtgggcaagtcatgcctgctcctgcggtttgctgatgacacgtacacagagagctacatcagcaccatcggggtggacttcaagatccgaaccatcgagctggatggcaaaactatcaaacttcagatctgggacacagcgggccaggaacggttccggaccatcacttccagctactaccggggggctcatggcatcatcgtggtgtatgacgtcactgaccaggaatcctacgccaacgtgaagcagggctgcaggagattgaccgctatgccagcgagaacgtcaataagctcctggtgggcaacaagagcgacctcaccaccaagaaggtggtggacaacaccacagccaaggagtttgcagactctctgggcatccccttcttggagacgagcgccaagaatgccaccaatgtcgagcaggcgttcatgaccatggctgctgaaatcaaaaagcggatggggcctggagcagcctctgggggcgagcggcccaatctcaagatcgacagcacccctgtaaagccggctggcggtggctgttgctaggaggggcacatggagtgggacaggagggggcaccttctccagatgatgtccctggagggggcaggaggtacctccctctccctctcctggggcatttgagtctgtggctttggggtgtcctgggctccccatctccttctggcccatctgcctgctgccctgagccccggttctgtcagggtccctaagggaggacactcagggcctgtggccaggcagggcggaggcctgctgtgctgttgcctctaggtgactttccaagatgcccccctacacacctttctttggaacgagggctcttctgtcggtgtccctcccacccccatgtatgctgcactgggttctctccttcttcttcctgctgtcctgcccaagaactgagggtctccccggcctctactgccctggctgcagtcagtgcccagggcgaggaatgtggccaggggatccaggacctgggatccagggccctgggctggacctcaggacaggcatggaggccacaggggcccagcagcccaccctttcctctccccactgcctcctctcccttcctacactcccagctcgagccgtccagctgcggtgggatctgagtatatctagggcgggtgggcgggtagcagtgctgggcctgtgtcttgagcctggagggagtctgctcctgccgccctctgccctgccagagacagacccatgcgctgcctgcccaccgtgcccctttgtccccatgtcaggcggaggcggaaggcccaccgtgccagaggctgggcaccagccttaaccctcactctgctagcacctcctccctttccccaaggtagcacatctggctcactccccactccgtctctggagcccaccagggaaggccctcatcccctgccgctacttctctggggaatgtgggttccatccaggattgggggcctctctgctcacccactctgcacccaggatcctagtcccctgccctctggcacagctgcttcctgcaagaaagcaagtctttggtctccctgagaagccatgtccctcgtgctgtctcttgcctgtcccacctgtgccctgccctccagcttgtatttaagtccctgggctgcccccttggggtgccccccgctcccaggttcccctctggtgtcatgtcaggcattttgcaaggaaaagccacttggggaaagatggaaaaggacaaaaaaaattaataaatttccattggccctcgggtgagctgagggtttttgcaaggaa

SEQ ID NO: 173086 - DNA, 1518 bp, Homo sapiens
  Payload ID: 14017
  Gene Symbol: RAB20
  Gene Name: RAB20, member RAS oncogene family
  Uniprot ID: Q9NX57
  ENST ID: ENST00000267328
  CDS Start-End: 215-919
gtgggctccgtgctctgcacccagctccttcccgggcgcgcacacgcgcttcctctcttgagctcccgggcgtccggaggcgaaggtcccggagcgttcacgagaatccgggtcccggcgagtccggggtccgctcctccagctgcgcccagggcgcacgagccggccagcctcggggagagggcgcgggggcgctgggggttcttacgggaagatgaggaagcccgacagcaagatcgtgctcctgggggacatgaacgtggggaagacgtcgctgctgcagcggtatatggagcggcgcttcccggacacggtcagcacggtgggcggcgccttctacctgaagcagtggcgctcctacaacatctccatctgggacaccgcagggcgggagcagttccacggcctgggctccatgtactgccggggggcggccgccatcatcctcacctatgatgtgaatcaccggcagagcctggtggagctggaggaccggttcctgggcctgacagacacagccagcaaagactgcctctttgccatcgtggggaacaaagtggacctcactgaggagggggccttggcgggccaggagaaggaagagtgcagtcccaatatggacgctggggaccgtgtctccccaagggcacctaagcaggtgcagctggaggatgcggtggccctttataaaaagatcctcaagtacaagatgctggatgagcaggatgtgccggccgctgagcaaatgtgctttgagaccagcgccaagaccggctacaatgtggacctcctgtttgagaccctctttgacctggtggtgccaatgatcttacagcagagagctgagaggccgtcacacacagtggatatatccagtcataagccacccaagaggaccagatctgggtgttgtgcctgactttcgagggcctcctggactcagactgtgcatgttgggaaggggtctgaccaggcaagctgtgatctgaaaggagcaaggaacagcaaggaattattttccagaatgacacccgcagcagaatgttggagtggaaatgatggctggctatgaagaggaggtcaacgtgtgtggtctcctcagtctctgtcagaggggtggggaggtgggaaacaggaatcctctgcaaagcccaatctgcagagtcgagacccctggtgctctctgccccgctgcctggcactggtcctttgcagccagccaccaacggcccccttgcccttgcagaggcagaagcctgcgtctgcacctgcacctctgaccgtttcagcaccctgggttgttaccacgtcctacaactctgacatttcttgttctcaagcgtttctcttcactgtgagttgtctttggtcctcccacttggtacttgtatcttgatgctttataatcctgactctcgacgtgttcatttatacaaaatcaggaataactttgtttttatactgattgcagcaatgttggctacatgtattattaaagaggatttttggaacaactta

SEQ ID NO: 173087 - DNA, 15546 bp, Homo sapiens
  Payload ID: 14018
  Gene Symbol: RAB21
  Gene Name: RAB21, member RAS oncogene family
  Uniprot ID: Q9UL25
  ENST ID: ENST00000261263
  CDS Start-End: 257-934
gagacgccattagagggaggcagagagggatcgttcttcgcttttcctccggtgcctgacgtggtgggctggggcccttcattctcggactttccctcagcccttccaggcctcgcccgaggagggcgtggggacagcgcccgggtcggcggggccggggcggtgggggctgagccggccgtggctgtgaaggcgctgccgcggctgtcgggagggcggcgcgacactcgggctcgggcggccgggaagcgacgggatggctgcggccggcggcggcggcggcggggcggcggcggcgggccgagcctactcgttcaaggtggtgctgctgggggaaggctgcgtggggaagacgtcgctggtgctgcgctactgcgagaacaagtttaacgacaagcacatcaccactctgcaggcatcattcttaacaaagaagttaaatattggtgggaaaagagtaaaccttgccatatgggatacggcaggtcaagagagattccatgcattgggtccaatttactacagagattcaaatggagcgattttagtttatgacataacagatgaagattcttttcagaaggtaaaaaactgggtcaaagaattacggaaaatgttgggaaatgaaatctgtttatgtatagttggtaataaaatagacttggaaaaggagagacatgtttccattcaagaagcagagtcgtatgcagaatctgtgggagcaaaacattatcatacttcagccaaacagaacaaaggaattgaggaactctttcttgacctttgtaaaaggatgatagaaacagcacaagtggatgagagagcaaaaggcaatggctctagtcagccgggaactgcaaggcgaggtgtacagattattgatgatgaacctcaagcccagaccagtggtggagggtgctgttcttctggataactgttcacgcctaagaaattaaaagacagaacaaaactgtggatcattgccctcaacatgaagactgccatattccaagtcacattattttaccaatggaattatagaattaacagtattttaaattacgtttataacactgcagagaccttaagtgctaaacttagtggagtttgtgaccagagaattggcattttctacaaatgtttttttttgttttttttttgtttttttttgtttttttttgagacggagtctcgctctgtcacccaggctggagtgcactggcttgatctcggctcactgcaagctccacctcccaggttcacgccattctcctgcctcagcctcccgagtagctgggactataggcgcccaccacgacgcccggctaattttttgtatttttagtagagacggggtttcaccaggttagccaggatggtctcgatctcctgaccttgtgatccgcccgcctcggcctcccaaagtgctgggattacaggcgtgagccaccgtgcccggcctacaaatgttaacaaagcaattaccaatggcctttttacatattttttctttaatgaggaataatatgcatgtagaaaagacctacttaaagtcttcatttatattctttcaaatcaaatctttatttaataacttatatatgttgttggaatggttacatttttgcagccctttgtattttgtggtagttgaaattgtatcacttctaaacagcaaactgtttttgtttttaattagcagatatctgaagtactatttttgcagggtttgcacaggcccgtaactgtctactactttgatataatctgtatacatcctgtatgctgagctggtaaaatacattgtaaattacatattaaatattttatctgcttttacaagcgcaaggtgcaaaaatatatacaatagtctcattgatgactgtaaagtgaattaacatttggtgattatgcctagcttttttgactaatataaagatcatagctccccttcacttctgtcttaacttgaacatggcgtgtttaaattttcatacatactttacttgaattattgctgttgtcacatatttttgcctctgtgagttcatctgatgattgagcagtagcatttgccttttgggttttttgtttgttattatagaagagatgacttctgctgattttgctttagaatggttaccttagaagaatttgggtggctcatgttgaatttcacttctgcaatagctttcattttctcataggctttataagagatgggttcagtggtatgagcagaggaagagatcccagatagtagccagttaaccaagactcattcatatagcacgtagtttatgttcctgaggcagcacttttagatcctttgtgagcaagttctatttgttcattgcttgccagagatgaacacagaatgttctgtttcattttacaagaactatcctgagtttctgtggatggaaacattacatgtaatgcagatatagtgaacactggaaagatttattaaagaattatatttgtgtatactttataaattagtccctcattagatttttttttcttaagcataagactgaacttaaatgtgttaattttagtagaatcaggcactgctcgcagaaggaacacagattgtagagattaacataaattgttcttgttctaatatatatattttttcatttctgtcgtgcttggaaaactagtaaatattatgtctaagataaaatggaatggcccctggatttacttcttataagaagcagtagtatgtaataaagctattagcatgagcaattaagaggctataaagagattatagttacaaaagaaatactgccatatttttaagttaataacttaaaccttctcaaatgggttaaaagttgaatgaattgacaccctgatgttatgatgttggaattttaacttaaactgggaggcattctgtgagccttcactttaccttctttaattattgtccttgctaaactcaacacagacttttctgttatgtgtttttgaggaagttggggtgggaagagtcagggagataagctaaaattgtcttcttttatggggtaattgtactctgtagtctcttggtttcctgtgaagttagtatttatgtgggggtgggggaaggtagcaagaatcatgggtatcacggtactttgtttttgacctcctggctctttcagacagagtgaagaaagcttttccattcttactgttgtagaagtagataggaaataagcttttctcattacagtgaaatatgttttaaaaactagagtagctgggcacagaggcatgcatttgtagggccagctacttgggagagtgaggcaggaggatcacttgaggccaggatttcaaatccagcctaggtaacactgagacctccatctcgtaaaaggcacaaaaactagttagagatgaaattgagctttattttaaaaaaacgttctaaagcctgataattggagagctatacttcagcttttcatcctactttaatgaaacagctagataggaacctctgctccagaattgccagataattattggtgggtcataactattcttcatattttttttttcttttttctcctttggtttctgtgttatctttcttaacctcacgtatttctttatcctttttagtgggggcctgtaattgaggctaattcaatagcaacaatagacaacatgatatggctgctgtcactttgaaacccaaaaggtctttgggtaggaatagagtaatgaaagaggaccagtcaacttcagtatatatacaaaggaaagacaaagagatgataaaccaaggctgaggaaatttttctgatgctttcttcatttctctaatataccttttgcattctttttctgataattgtgctattaggcagaagacacaagttaccacgttgtgtattaaaagcagtaggtaggttgtgccagtattttttcagccagtaagcatatacagttaacttatataattaaaaattggtttaagatagtgattaaaaatacctgaatattatgttaaaagtatacaatcattgtttctgtaatgatgatgggtattctgcttcttgtttttcattgtaattacaggggaagattgtttttgaaaatgtatattgccatgcttttggggtaagcagtaatgtgaaaagaaaaaagcattatgttattgtatgaaatataagtgttcagatttgttttgtctggggtgttgcctaagaataccctaaagctatggctgttactgcattgaaatcttttttttttttaatagtagccatatgttattagtggagtactttatatttgacattaaagtgaagaagaagagtagtacttcacttttaggtttttagtagtgaaagataaaattggaaaaatagggaaagagcatagggaggaatagaatggaagtcaagtaaataaaaaactacaacctgacagttttttaaatcactttgaaaagtacattacttttatcaaagagtttctaattaaggcaaactatgcattatgccaaatattaagaacattttaaaaatggattgtgatactgtttatttctttaattatataatttgcaattttctgtattataagtgctaccaggattctagatagttgatcttacatattcagatagtatagtttactcttataattacccgttacgttatctctaaaagtagtttgatctgtgcctttaacttttagaattcatcttttgacttgtttgccactgtagagttttcagttttctctgtagattcagtgtgacaaagagggaatacataatttgtgaccatttaagatgctgatattttctggaaaaggatatagatagtagtagtgacccgcaggagcctcacaataatgtctaaagatataaactgagtagatccctaagtactcttctctaaattataaaatgcattacctaggctttaatagttaaaagctggaatttattgaaccgcatctacttgatttcataatatgcattgattttagtatgttgctgttctgttatctgtaatcaactataacagagtaatatatttggtgttctggaccaaaattcgtgctacacatatgtctgatggcctttaccttttcaagaaaacagttgcaattttgagcaaaattttcctagttgtaatattttaatagtgttatgtattggaaaaaatttagaaatactcctaagagttttcaatttcaagcagaaatgcttctcttctaaataaataccacttaattgatagacctttagcagttcttgtgctatctaggatttatacatttttgcttttctggaaaactgctttggcgcattaacctttctactgcaacattttctcttcagtagatatatgagtaaacatgatgagttaatgttacacagcatacccagttaggtctcttattcttaaagcatctttctttagaagtctgcacatattttcaaatgcatcatattaaaggcacaagtcaagaggaggtggagttgcctacttcagtggcctttattcccactataccagttctcagtcttgattttgatactttctggcaactgtatcatctcttcactatcacgtattttaagaaaaagctaaggtgatttctttacatttgaacatgtgtagatcaatgagagaatggtgagggatagcaaggataaagtataatgttgaaaagtagaaagaagtggtatctgctaaactctagctttagtagcaagctattttaaggaaatcattgtatgtggtacttcctagaaatatgaaagttcctcattttgtatttaattatgtaagaaaatgttctaggaaaagaataaaaaacatatattgtcaaagtgccctttggtagtgctcccaaatggtagtaactattggtctctagtatatactcctcaaatatctttttgctatgtattaatatatctatatgtttacatatagaaatacatagtgttgtgggttttaaattttcacataaattgtgtcttacccatgtgttttgccatttgccttttctcttgccaacgtgtctaggagctctttggtaaatacagactttttcattttatttcctcccacatttctatggatgtgtcttgcctttttcttttttttttctttctttttttcttttttaaaatagcctctgactccatgaaacctgaaaaggaatctggtctgttaggtggatttcattagtatccaaatttatttatttttttatttcatttttttgagacagtctcgctgtgtcacccaggctggagtgtggtggctcagtgatagttcactgcatccttgaactcatggactcaagcaatcctcttgcctcagccttctgagtagctgggactacatgtgtaagccaccatgcctggctaatttttgtatttttcatttttagtagagatgggaagtcttgctgtgttgcccaggctggtcttgaactcctggcctcaaccattcctcccacttcagcctcccaaagtactgagattacagatgtgagccactaggcccagtcagtatcatagaatttaaatgcaagccaatgcttagacagaatcagggtctgctttaagcatgtgaatcaggaaactagaaggcctcttgtaatgtatttgaagttcattacttttggctgacggttgactgcttagtgtataaaatctaggagttaactttagcagattcttttatcagaatacgttttttattggagggaagaaggaaaaagaggaaaggtataactgatggggaaaagtacaagataaactaaaacaagtctttatacaactctgacagcaactcccataacaggacatgatgctaccaaaaattcaaacttgtatttgatctgtgcctttaatatagagtaaaaacaaaagttcctttttagatctcccttccctcatcatcccacatccctttttagaggtaaccattgttaacagtttggtttgtgtctttattatgcagttttatatttatatttggcctttgtaaattttccattccctgaatggaacttctaccctatatcaaattccaccctcaactgaccaatttaccaaggccaactagaatcatacttctttttctggaagttttttttgagacagggtcttgctttgccgcacagactagaatgcagtagcatgatcatagctcattgcagcctcaaactcctgggcttaagcaatcctcccacctcagacttcgaagtagctggtattacaggtgcataacaccaccacccacgcctggctaattgttttgttttttttgtggagatggctctcactttgttgcccaggctggtttttgaactagtttcaaagtgatcctcctgccttggcctctcaaagtactaggataacagtcatgagccaccatgcccaccctagaatcatactcttttaaagcaagttaaatcagcagtaatagttctggaactagaagttaactacttactggacttttgagatgtaagtttaccatacatcaagcttaaaaacttgtagcgttctgggaaagtcaagtcaaactcttgaatgctatcctctgtggaaatagggttgggaaagagcaatgtacaagtccaagctccttaatacacataaaactctgggttgggctcatcctcttggtgtattttcctacttggagagcattacagtgtccaacaatttataggagcttctctgcactgtcaagactatagcttagcatatgtgtgctatgacacaaggttaaacgtgtgccccagaacaaatgcatttattcatgtttgactttaaatgaaaattcagaaagcaggttaagcatatatgtgagtttaataattgtttctgtattttaaaaaattttaaaacattcagctttttatgactttggttagtttcactcatttgttgagtgccttctgtatgcccagtgcacaaactgctatgtgcccagtgtacatacatgggagaaccagatagccaaagtgccttcctttatcgttggaacctagagatgagctgatacctgttgcacatagtccaagatataagtaatttatctggggatataaggtcacctgtgcacacatgttcacattctgtgtttgatcagatatgtacctgccaaacttttggagtgagataattagaatgacagtagttgaagctgacagtgaatttgaggtaaagctggaaagaatgtttttgaattttgcaaataatacattttcaagccagattaaaattgaataacttactttctagcttcaagggggtaattaagtgatcctctaacccaaattgcttttccaaattttgtggtagcagtgaataaactgatgcctcctgcttatttagacagcagccatttttgtttggtttggtttggttttgcggtgattttttttaacctagaaaaaatacaatttaaaaagcaatcatgttgttttctttgcctttgacagatgtggccttgtcaccacacagtaagccagaacacaatccattcctgagtcatagtaggatagtttgtgtaattctaaatgcactctccagtttaagagtgtgggtccctttttttctatctgaaattgaagatacaggtcagaaagatggtttaatgaatatgaattttctaaacatcttttcagtgtcttttaaggatatttttgatattacaatataataaagttaaatcatctagtcctcctggcccttctggttagaaaatagagcgaaatcatccgtttaaacacacacacacaaactatcccattagttggttatacacaagttactttcattcttactagttcacaaaaggttagtaaatttagtgatttaatgagttcttcaaaacataaaagtcctgtaaaggaaaagctagaggatgtgagaggagtaattcatccccatcaaaagattttagccaaaagtagtggcataagaaatttatttatgcgaaagacataattttgggtgaactttcttgaagatggtcagaaagggcattgttaaaggaaggagatggtagattttgggttctgggttctaggttctaggctaataatttactactttggtatgttgccttgaggctgacatttgctgctctgctaagactaaagctggccctttccaatcaaaagtgttaaaagctggctgggagccatggctcatgcctgtaatccagcactttgggaggctgaggtgggtggatggatcccttaaacccaggaattcaagaccagtgtagacaacatggcgaaaccccatctctatccaaaaatatacaaaaattagccaggtgtggtggtgtgtgcctgtagtctcagctactcaggaggctgagatgggaggattgcttgagcctgggagttagaggatgcaatgagctgaggtcgcaccactgcactccagcctggacgacagagtgaggccctgtctcaaaaaaagaaaaaagaaaaaaaaaagttaaaagttgtggcatggtggctcacgcctgtaatcccagcacttttggaggctaaggcaggtggaccacctgaggtcaggagttcgagaccagcctggccaacatggtgaaaccctgtctctactaaaaacaaaacaaaacaaaaccatatatatattatatatatatatatatatatatttttttttttttttttttttttttttttgagacggagtctcgctctgtcccaggccagagtgcagtggcgctatctcggctcactgcaagctccggctcccgagttcacaccattctcctgcctcagcctcccgagtagctgggactacaggcgcccgccaccacgcctggctaattttttgtatttttttggtagagatggggtttcaccgtgttagccaggatggtctctatctcctgaccttgttatccgcccgcctcggcctcccaaagtgctgggattacaagcgtgagccaccgagcccagctatatttataaatttatatatatttcatatatatattatatatatataaaattaaccgggcatggtagtgagcccctgtaatcccagctacttgggaggctgaggcaggagaattgcttgaacccaggagacggaggttgcagtgagcagacctggtgccactggactccagcctcggtgacagagtgagactctgtctcaaaaaaaaagttaaaagttgttaactagatgtcgaattattttcatagtaatcaccatgtgtaagcaattctcatctgtggaatgtttgacagggataagattattgaaaattggggggaattttcttaaatatggaactaagagctaaagagttcaatgatgattaagaccactagtctggcaagtgacttttatttgtccttttctattgataatgaattctaggaatatggatggatttcattagagaaataaaaatgagcaagatttgtgattcagaatattaaaagttaagaatccatgaatagccccttaaaaatattgtcaaagcatcatggtatttgtagtggtgcttaaaaaagaagcagcagcagctgttctaagccaagcactgcttgaaaacaaaacaaaacagaacaaaaccttatatttaataaaatggagaaatttgggaatgtccctagcgtaataatgccttctactgacatttaaagtcagcttaaacatcattagggaagactatgactgtttctatgacctctagtcacaaatttaactaatttaaggttaactaatacctctttcagagttgggcaaaagaagaaaaaaaaagcctttatttgtgatcagtaaattataaattacacagaagcttccagctacctggtatttgcatgaagaattctaaattttttatatgccataatttttagtaatgctgtccttgaattcacttacatctctgctctggttttttgaagctcattaggatgatacctgtcatctcttggaaacactggaactagagaactggaggtgttcacccccattttttgctacattgttgaaaactgagtagaattttgtgtccaaaaatccttagtctgtgatggaattttttaaagtatatgtgaagttttttacttcttcagtttttcaagataattttgctgtttttgctttttatttatttgcaactagaaattgcatgtgccagttacttaatttaatacatctaatgggagattcaaagcaaaccattaaaactaccatataaactcaaatgaaattttatgacattctaatgtacatactcgccaagaaatgctacaaggagcctctctgcaaatgcctgatggggcactctgagaattaaacaggaaatggacaggaaaagaggcaaagcatagaatagcctctgtggtatacacacagacaatgtaaaatccaagaaatataaggtccaaggaggaattggttattgaagtagagaacctcatcatgagatttgagaatagctttagagttactcttgggatagtgtctcatggccctgtgagggaactctacaaattttatccattttgctgggcagttttaagagctactttttgtctgtactttccttaattttcatattatttctagcttttacttcatcttatgaaagattaacttagaggttagaatgcttacatttgcaaatagcctgaggaataaatatgtgctttatcaaagtggaacttctgattttctgtaatattaggatggacatgtgtctggcttatccttcctatctaggaaactggtgtcattaggaaatacgttaacataagatccctgactataaagtaagacttattatcttgtatagtttgtagcatttaatcttctatttcagtgattggtttggatctacttaattttaagctttactggtcatttgtccccctcatgttgtacctaataagtgtgtagtttttaagtgaaatcatacataatttcaaggaaactgctagagacaatgttgagtatcatcaagaacatttaatcaaacctgttgactaagagctttagtttggcttacaatttcatatgtaaatccaagaaaaagacttgtaagctaaaaagcctgtttcgttcggaaaaaaaagtacataacattttaaagatttgtgagaggaaaaaagcattagatgcgatagaatggaataatctctttttagaagtaaattagtttttatttcatttgtgggtggtattgagaaaagtggtggaaataaatacattgagcagattcagaatttaatagacacttcgtgtttccattttcataatgggggttagtcataaaccattctatgtggagcattttacaggggctctgaaaggtatacaaaatgtactactataattaatgtcctcaaggaacttaaaaacctattggaagatttatttaacagaggtaagagaatttggacccattaaaaatggaggaaaaggtaaagttagtatttgtagatgatagtgcaaagcttaaaagggtcaactgaaagtctcttaaaacgaatacagtcactgggtataaaattcatcacagaaataaaaagctttcatttataaaaacaacagccagttagaagatataatagaagaaaaggccccatttaaagtaagaccaaaggagagaagatacctaggaataaacaagttatatgcgtgaccacaaaaccaaaactttgtatttcacatgaaaataaattcaaacacatggagatgcatatcatattcttggataggaagacaacatacacatttcagttctctaaattgaatgcaatcccaataaaaatataaggattaaaaaaaaaaaaaactagatcgctgattccaaagtttctttgaggaaaaaaaaaaaaaaaagcaagactagccaggaaaactgaaaaaacaatgaggaaagactggccttatgaaatatttaaacaagagagctccaataattaaaacagtctggaactggcatatgactagacagatcattcaagcagaaggaaaatgaacccagatatgggaatttagtggaggagaagtgatgtttcagctcagtggggaaaatatggtttattcattaaaggtagtaggacacttgggtagctatagagaacaaagctggattcatacctcataaaccaaaatgcattccagtttaaatatgaaaactgaaatgtttaaagtacccaaagaggttgtcagagaatttttaaagattttagtgtggtaaaggatttcctgaatttgatataaaatttggaatagaatttacaataagaaatgataatgttttcactataaatttgtaacaataaattattattatttttgagatggagtctcactctattgcccaggctagagggcagcggcatgatcttggctcactgcaacctctgcctcccaggttcaagcaattattcctaccttagcctcccaagtagctgggactacaggtgtgcaccaccacacctggctaatttttgtatttttagtagagatggcgtttcacagtgttggccagtctggtcttgaattcctgacctcaagtgatctgcccacctcgacctgccaaagtgctgggattataggtgtgaggcaccatgcccaacatataacaataaattatatcactatataaaataaattcctcacagcaaaaaaccaccataagcatagtctaaagaaaaatgacaaatttggaaaaaatattttcaaatcatatcatgcattgcttaatttataaagaacacctagaaatgaaaaagtccaatgatccaaaaagaaaaaggtacaaaattgtaaacagttttcacagaaaagaataaaatgattcaagccggaaaaaaagttcaactttattactaagagaagtataagacaaaactatactgagataccagttttttaacctattaatcaagaaagactttttagttttataaaacattgtaatattctagatattattggtaagaatggagggaacaagtatttttgctgatagaggggtaaactggaacaaccgctaaggatgacagtgaattctgaatttatttacccaatgtactcttcaagttgcagaggctgagaaattattaaactgttacccagaactttttatgcagatgggggggcagtctgaatgctaattaagttttctcaactatatgctctctcctcatgatttgaaaggcaaaagtgaagcagaggccaagttttgaagttcttgaatgttacgaggtagtgaaaaacgtttccatgcagcagtgatcaagtgtctatcgttcagcttcctgaatatggataggctgtggtggtggcagcagcttcttaatctgacattccaacccctagattgtggtgttacatcttctttctccagcttcccaggagtgaaaggttgtagtggctggcctctggttcccagcagggctccatggtgaccagaggttgtagttcccccagtgaatcatgtttgtgtcactgtgggattcattcccataggctcaacttagattcctaaaccctgctccttcaacccttccagtaactttataagcaccaaattccatttaaaaagtgccttcctgtttaaaatatctataatggcttctgtttcctgcattgaaagctgactgatctggagggcaattgggcaacagcaatcaaaattgtcttttcttttgacctagcagtttcacttcttggaatatatcctgtaaatatgcttatgtatgaaggaaatgagtttgtacaacgtttttcaatgcagtattgtttgtaaattgacaccagtaggggaatagtaaaatcaattactatgcatgcatataataaaattttaggtagctataaaaaagagaatgagaaagctttgcatatttaaaagaaaccatcaacaggaatattaagtttttaaaaaaagccagggcagaacagtctgtatactgtatattttaaaattgaacaagtatagtagacaattgaagtatagtaaagataaaattaattgcacaggccaggcacagtggttcacacctgtaatcccagcattttgggaggccaagatgggcggatcatatgaggtcaggagttcaggaccagcctggcaaatacggtgaaatcccatctctactaaaaatacaaaaattagccgggtgtggtggcaagcaactataatcctaactacttgggaggctgaggcaggagaattgcttgaacccgggaggcggaggttgcagtgagccaagatcatgcccctgtactccagcctgagcaacagagtgagactctatctcaaaaaaaaaaaaaaaaaaattaattgcacatgaagtatacaagttcgatctgtgaaaccaccatcacagtgaagataattaacacatccatcattccacaaaatttccttacactttcttgtaatcccttctccctcccattcctgctttctttaaactatagtttagtttgaattttctataattttatataaataaaatcatataacatgt

SEQ ID NO: 173088 - DNA, 8670 bp, Homo sapiens
  Payload ID: 14019
  Gene Symbol: RAB22A
  Gene Name: RAB22A, member RAS oncogene family
  Uniprot ID: Q9UL26
  ENST ID: ENST00000244040
  CDS Start-End: 282-866
cgaggtgggcggggaggtcaggtgacgcggccggcgtcccaagatggcggcggcggcggctcccggaaggccgcggcggcgtcccggctgctaaggcgggccccacgcggctggcagcggacaggccggacctacggccggaggacgggcggcagccgcctctgcgcggaccggggctgggccgtgcggcggcagcggcgccaggggatgctcttgctgggcctggcctctcccttctcaacttagggcggcggcgggcccgcgcccctggctcccgggccatggcgctgagggagctcaaagtgtgtctgctcggggatacaggtgtaggtaaatcgagtattgtgtggcggtttgtggaagacagttttgatccaaacatcaacccaacaataggggcatcttttatgaccaagactgtccagtaccaaaatgagctacataaattcctaatctgggatacagctggacaagaacgatttcgtgccttagcaccaatgtactatcgagggtcggctgcagctataatcgtttatgatatcacaaaagaagagacattttcaacattaaagaattgggtgaaagagcttcgacagcatggcccacctaatattgtagttgccattgcaggaaataaatgtgatcttatcgatgtaagagaagtcatggagagagatgcaaaggactacgccgactctattcatgcaatttttgtagagaccagcgcaaaaaacgcgataaacataaatgaactctttatagaaattagtcgaagaattccatccactgacgccaacctgccatctggcggtaagggcttcaaactccgaagacagccttcagagccaaagcggagctgctgctgaccgaacctcagcctctcagacttgatgatgaagtaggtggtcctgaaagttaacaggagggctggggtccctgccaccagttttcacctagccagtcttgagtcttctccgtgcaaaaaggattcacagaaatggaccagttctgttctccaaagactgcagcaatgatatttcagtctgtgaacttctattatgtaaagaatctctagtgtacaaagggactacatcgttggcttttgaccttgctgaaaaggaacatataattgtatggatggtaggattaagttgttgagtagttttgtaatcaagattttatgtaacatttgtaaagggaaaattagcacttttgtggttcttaagggaaaagaaacagaccttgtggagattataatttccttggtttctgttaccactgttagagggagttgtatcatttaacatatagtaggatagtttaagtgtagggaggacaattattgtctgaagctaaaatgggttatttataggactgatggaaatgatttcatctctgccatctctaaagcacttttcattgaacatgttagcctaggatacgtacagtaaattaacaatgatagcagcagatgcctagctcatcctgggtttgcttctgaccttgtcatgtgtgtgccaccaaacacgttattggcacctttttaaataagctctcatgatcaagatggtgatggtagagaagctgcccggaataaactgaatttcatatgttctaaaatgactagcaatggtttaaaaaggaagaagagtggaagtgaagaaggtggtataaatgctgtcaatttttttttaacccaagtattttggtggggaaaagcaagtatctattgcttagcatatgtaaagttgtagtctatatttatggggccattgcttaaagattataaattatgtaaatacattaataaattctaagtttcatttgacattccattgaatctcgcacccagtcttgcgtatgcctgcccagttttcagcctcttaacgggagactcaagcacattggtattgtataaaggtatagagcacttagcttacaatctttaaaggtttctctgccttcccttctacccacccgcctcccaccagatcccatctggaaatcataataaagacatatgccactttgacaaacctgactagtccttactagcctgagggtaaaagattaagctccaacctcaagtcatttacctggtcttggtaataagtttcttttagcttgtacagcatcctcagaccaactgaggagctttccttgttaacaatttagcttatctttctgtttcctttatttttcccctgcctctgttagtggttaacactcttttccctcagggagcctaatgaggtttttaatatcatctaaaaataaagcattgaagtgaagttggtgaaaatttgttcctggtctaatttggcacccttccaacctgagtattgtaggggaaggaaatttacaagatttaataggaaatgaaacagcttgaatttcaaactaaattgtattttcagagctatcctgaaactgaacagctgaaactttaaaaaataattggtattattttgtgccccccacttaatatggatagattttaatgggaaaattataattcagattaaataaaaaacaattcccttttccctgttgtatatcttaagcatttggaattttttttatcttctgaaatcatataaaaagaatgtcattagtaaaaattctaacttcgttttgtttaaaagacatgtggatgctccatgcccctaggattttgcttcctccccggtgctaaattagcaagctcctagagaagccatgtgattcccagagccaggcgctttacacctaaagtagtttgactttcttctgtatacatccagatggatcccaggcatccgggcaccaccctggtgtgtccctagaattcccactgctgggcctctatctccatgacaacaaaataaaaacagaggttgcttgactcattaccaaagaggcaaagcatgtgcgaccctttctgtcttattttaccaaaagatggtgcaaatctatgaccttcacattttttccaccacacccaccagtagctgttggtgattgcatggtgtctcggtgcatggggaaaggcaaggtcttctgagctcatcttaactggtgaggcatctggatgtgtctgatcttactgtgatgttttactgtaccgagcccaatgtgggtccatctcatcagccctttgctgatttcatgatttctcaccctccctcccatatgtagggtgtgattctgttttattatagccacatgttttattaacagaatgagtgatatgaagcttgtacttatgcatttctcgggcctcttccctcattttcatcagtctgtctaagaacttgactcggcactgtttctcgtgtaatatccttctaatgcttagcaacaacaacaaaaaattgctctctcagatccataatccatactcagtgaaagcagggaaaaaatattttcacttattttatttgcttctaaaatgcaaagatgaatactaaagtcagaagcagtgtttcattttgaacacattttggattattaagctgactaagcaatgatctaatacacatttcatattttctttataataatttcttatggagaagaggctatatttcaaaggaattgagacatactcccatctataaacatgtttggttttcttacgatacagggccatttttttaaaactctcaggactgaacagaagagaaaaattattaattagctgctactgtatgttgattcttttcggagaaattgaaataagctctttgcaggcgtccaatcctagaaaccaatggtctccagaactctcacacaagtgtttttctgattctatgataactaattaaccatcatctggtgattaaaagaacataaagtaagattatgattaagtgtccatcacctgcctgtcagccgtggtcagaataagttttacacgaagcaggtgaaagatttagttcttttcaaagtaacttattttcttgtgacccgtttatgatgttgtttgaagtccctgtttcccattgtgtacgcactttctggatgtctggaaggatcgggacttttgtgtgagaggcttgagcgcctcctctatgtgggctggtgtccttcttgaagttgtcaattcctcttattcttaaatatctaaagggaaaggaaaccaactttaatttcagaacttctctttacgtcttgtatgtatttcttttctgttctcaaggaggaaaattggtctaggaagccttctaaattaaactctgggaaatatagtaatgaaaatatcctttagctaactttcctgtaactgtcaaaccaaaatgtcagtatttttagggcattgtgttaaaataagcagtttagattccgacgacactgcactaattggcatgtcagcctccagctcagaaaggcatttgctcatggttacaggcatcttttagattctaagagtgagttacagaattctttttggtactttcacttattctttcagaatacatcaaggatgtgatttatgggcccttaagagtataagatataggtgcacagtatgttacttaagtaacggatgagcccccctaaacatccacgtgtctctgcaggaacctgtgtaagtattgtgaaaacccttttcttccagggaaaaattattggaaattccttaactgagctatacttggtacttgctctagaacatttgggaaatgacaaactcaggctggctctcctctctaacctcactgggctataaatgttccttctaactctgtaatgaaagttcagtgacaaactagatagtgaacctgtgaaagtcattatttacatttgctttaaagggacagttttaccgttcaacttcaagagtttttctacctctttaacagttaatattttttaaaggaagaaatggaatgtaccttcaggggtcaagctgttaactgtatacctgcctctagttagcttggtttatcaaaaggatttttaaatgattcaaggtaatgtttaggatatttgttttaactcctgctgtgctgtgatttaaaaaaaaatagtctaagaaacaaatttatccatgagataaacatcatattttatagttttagaaaaaagggttgggggtggaatttagcctagaacttaaagaaacaacctctgcgaatttctcttgacagcggagttgcttgtcttgacttctaataatataaatccaggcagtttgattatccgatttgcaagaaactttaatggaattctggggcatttgtcctgttttatgtgcaaatgaaagtctaaaaaatatgaggaagatattacatttttcaggagcctccattttttcagtctaagagaatgataagtgagaggcctattgtgatgaagttgcattggacataatgtgggaagtgaataaatagaaccaagaatcttcatctatctctgttggtctttcaggattctcttagcatataggaaaatgatttaccttccagatctcgaaggacttccaatagcatagatcaggtttaatttgatggtctataccatcagaaataactaatatctgttttctttccttttagagtataatcaattatggataggccagaatatttttggcttcaaaacaaaaggattcataagcttaaaaaaacaaaaatcccaaaccttccatctatcccttttattacgttgaacattttagatagtaagattaagatgtatcattagtatatggtgaaattaaaaccgtggtgtctaacagatttaacaaaaagtgtttaatttactgcaagttcatttttagatctgtatggtgcccagtactccacaaaatgcatcataattgaaacaacaaaattattttcatgagcaagaattcaagtatcaaggcctatcagccaattaaaagccgtaagatagtaatgattttttttctttttttttttttttctttttttagatggagtctcactctgtcgcccaggctggtatgcagtggcgcgatctcagctcactgcaacctgtctcctgggttcaagcagttctcctgcctcagcctcctgagtagctgggatgacaggcgtgcaccaccatacccagctaatttttgtatttttagtagagatggggtttcaccatgtttgccaggctggtctcgaactcctgacctcaggtgatctgcttgcctcggcttcgcaacattctgggattacagacgtgagccaccgcgcccaaccagtaacgatttttttaaagggcctttcttaattgacagttttaagctgtagacattaatattataacaaacaaaacatgccagttttactgattccgctttttgcttgattcaggaacttttcattgtttggggaagcttttgaatgcagtactgtggaggaaatcatccttaaaatagcatttcacacatagggccaaaattgaaattgtcaaggaaacccctcagcatctaacgtcatcttgtagaagagctgggcatacctcttcctctaggccaattcagaggccactggccacccaagtagagtggggcccactggcatgagtagtccctgtgcccatgcccatggtggtgcttgactttgctttggggcttaatcctagtatcatttggccattaatttttaattaagtttatacttgaataatcagttttactcctgaaaaattttgaagccagcactgactttgtttatattcacttaccttgtatatgaacttatgacattagagtttgtgaaactgtcttaacgtggctcatacacgtgatgtcagagggactggtcagttctttacagggtgaattaatcggcagctggctagtcagagcaactgatgggtggcttttttttctttttttttttgagacggagtctcgctctgtcacccaggctggagtgtaagggcgcgatctcggctcactgcaacctccgcctcccaggttcaagcaattctcctgcctcagccacctgaatagctaggattacaggcgcccgcccccacacccggctaatattttttgtatttttagtagagacagggtttcaccgtgttgatcaggctggtctcgaactcctgacctcacgatccgcccgcctcggcctcccaaagtgctgggattacaggcgtgagtggtggccctatttttaaaccattcgttacgctgtgtagacagagctttattgccctggaaaagattttttttttaactctcatgcagttcagtctttccatcatttcactttgtgagtcactcacataattgtcaatcattcctctgaccttcttaagaatttacaccttaccgtctctgtgattgaagcagacttctcgctttatttcccttaggctcatttttctgtgggctctcccttaaagacacatggccacagacacctccttcgcatatgtaatctgccttcccctgcggccttccgtggtcacagcaacagggactgctcaccccctccagctggggcttttctaacaagcacagtcagaaatgcgcaggcctggggttggggatgaacagaagttgattagtgggcacagaaatacagttagatagaaggaatagttccagcattcgatattacagtagggagactgcatttaacaataattgattgtatatttgaaaacagctagaagaataagaatattcccaacacaaagaaaagataagcgaggtgaaggaaatcccagttaccctcattcagtccattacacattcgatacaggtatcaaaatatcataggcacctcaaagacatgtacaactcttaatttaacatttttgaaagaaaaaaaaaccggccagagcattaaaacaaataaaataagaaacacagaggccagtgttaggtgaagaactccgctgcttcagaaagagaatagcagcgctcgcttaccgtgggaacacggccagttaacaaaatgggttttggttttttgttttgttttgttttaccattggtaataagatagttaacataagtggtcagaacttcgctgaatttgtaataaagcatttgttaagcgtgtaaaagtccaaattaaaagtcttgaagaaaaacagctatggcaatgagcctagacatttttcaaaaaaaaaagctaagccgtcctaccagcaatctctctttctcctaagaatgtcatgccttctcaagacctgatgaaaggaataagatatttgtgcctttttataaaagcatctattacgaaagtaaaattcagttgcttacagttttggccgctttgtagcactattataaacagcccaaatttatggccttggacttactgcatgacacatggcctggttacctgtcatggaatgctgcagtggtggtttgccaagcttctgtggatgtttgaagactttatttttgcagtcttaaccttgggctggacctaagtgtatgtaaaccatatgatgcctgtattgtttatagatgctgacaaaagaaaactagaccttttgttttttgttgtaagatttttgttttcatgcctatgctcatagtagatagtttgcaaatgaaagttgatttgccatacttttaaataatattgttttagcttgaatattctataatacacttttatagagtataacatgctaaatcactgttttgttgtaagaagggtgtaaacattttgttaataaaatgctatgtttacaaatata

SEQ ID NO: 173089 - DNA, 2546 bp, Homo sapiens
  Payload ID: 14020
  Gene Symbol: RAB23
  Gene Name: RAB23, member RAS oncogene family
  Uniprot ID: Q9ULC3
  ENST ID: ENST00000317483
  CDS Start-End: 155-868
tgacactggttgctacagaattaactttactcggagatccgaggagccatcggcagttcccaggagtaagaacctgagagcgtgtgagaatttgagagggaagatctgatctcctagaattagagttggtacagaaaccatttcagctccaaaaatgttggaggaagatatggaagtcgccataaagatggtggttgtagggaatggagcagttggaaaatcaagtatgattcagcgatattgcaaaggcatttttacaaaagactacaagaaaaccattggagttgattttttggagcgacaaattcaagttaatgatgaagatgtcagactaatgttatgggacactgcaggtcaggaggaatttgatgcaattacaaaggcctactatcgaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaatgaggaagctgaggcactggcaaaaaggttaaagttaagattctacagaacatcagtgaaagaagatctaaatgtgaatgaagtttttaagtatttggctgaaaaataccttcagaaactcaaacaacaaatagctgaggatccagaactaacgcattcaagtagtaacaagattggtgtctttaatacatctggtggaagtcactccggtcagaattcaggtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcagtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattgaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcacttgggacagtagctttccagctaagataattgcgtgaactctgttaaaactgattatcactcatcaatggctttatttttaacctataaataacccctttcaatatacctggtttttacagcattgcaaaatctgtaaaaataacttttattggaaaatgtcatgaagtcatttttcattatttgtactaaacaatgttttatgtactccttttgtgttttatcttttgtttttccatctgtactcccctcatcctcctaatgttgagaaaatcaaatttcctgggtgtgtccttgttaagtgatcaaaagtaaatgttctctttgccattttagatggaaaaataaaaaaaattaaaaagtaaa

SEQ ID NO: 173090 - DNA, 4837 bp, Homo sapiens
  Payload ID: 14020
  Gene Symbol: RAB23
  Gene Name: RAB23, member RAS oncogene family
  Uniprot ID: Q9ULC3
  ENST ID: ENST00000468148
  CDS Start-End: 655-1368
acggcgcatgctccgcagcgcggcgggtccacagatgaggggagtcgagactcccgcgccccaccacccccggcggagctgctgctgagccactcaatctgagccctggctactaataaagttcgtttaaaaatcataatcattcttaagagagcgaaagagggtgcgaactagccgctcggccccgcagggagagctggcgcgtcgggaggagacagcggcggcagcggttgcgccgcgaccaggaggagccggtggcgccgggcggcgggtccgcggccggtgggggacggtgagtagcggctcgcgctgcggtgcagcggcgctgcactcactcgccctctccaggggctgggggttcgtccggctccactggggaagactcagcttctccccggggtcccgggttgtgccttactctccggagtgggcaggggtatcgagggcaggggcctcccggcccggctcccccatcccccggttcggaccgccgagcgccggctctcccctccctgagcaccgatcccaagttccagctagagaaggtgggcggcagcgccagcccggcgccccctcccagctcccagcgatttgagagggaagatctgatctcctagaattagagttggtacagaaaccatttcagctccaaaaatgttggaggaagatatggaagtcgccataaagatggtggttgtagggaatggagcagttggaaaatcaagtatgattcagcgatattgcaaaggcatttttacaaaagactacaagaaaaccattggagttgattttttggagcgacaaattcaagttaatgatgaagatgtcagactaatgttatgggacactgcaggtcaggaggaatttgatgcaattacaaaggcctactatcgaggagcccaggcttgtgtgctcgtgttctctaccacagatagggaatcttttgaagcagtttccagttggagagagaaagtagtagccgaagtgggagatataccaactgtacttgtgcaaaacaagattgatcttctggatgattcttgtataaagaatgaggaagctgaggcactggcaaaaaggttaaagttaagattctacagaacatcagtgaaagaagatctaaatgtgaatgaagtttttaagtatttggctgaaaaataccttcagaaactcaaacaacaaatagctgaggatccagaactaacgcattcaagtagtaacaagattggtgtctttaatacatctggtggaagtcactccggtcagaattcaggtaccctcaatggtggagatgtcatcaatcttagacccaacaaacaaaggaccaagaaaaacagaaatccttttagcagctgtagcataccctaagatgttttgggaggaaaacaattgaattacattgtgcaatgcattaagaaacccatccagctgtcatggtatgttacaaggttttcagcagactttgctcctaatggctctctgaaagtgacagacttaaatattgctctgcagtgcttttcagaatgtagagtgagacctctggtggaaaaattattgccctgtggactcctttaattttttttacattagacgaagcttctcctgtttgtaaaggaatgctataagaaatttcaaacacaggttttgcggaattttaaatgctggaaaacataaatgaaatgcctaaatatattgttacagattttaatactgtggatcaaggaaagatagcaagcattcttttcctgaaattggtcatgtagcttttctgcgaaatagtattgaatctgaatactttcacaaaataatactgaaaggtaaaccctaaatcttgccagactgcattagtattttggcattgaaacttgtgcaatatctgtgtaatgtagaatgtggggtgtgcatgcagatgtctggtactggagtaagctgaaggtatgtgcagtatttaagaaaatgtacattctaattaattcacttataaaaccatttacatattgtgtatatgtttttattttcaaatgataaactctagacatatattttgcaaaatgagcttgggtttaaaaagtgctttgtgccaaaaatatcatacctaatttttatagtgctttactatcagaatttatattgtttattatatcttttaaaagcagtaagcagttttcatctgacagcgtagataaaagaggagtataggaatttgaatgctagagcatctcccaggtgagccttattgcagatctttttgatatagtcacccataagcatggtgagctcctgctctcataaggtcagccaaagccccttaagaaggtacacagcacatctgcagtcattcaggaggtcctgtgaagtgtggtgatgcatctaacaccttttgctgctcactgagaacccagctttgaacttacaagattacactaaccatttttaaagtgcacaaaaatattattattagtcttaactaaaattacatattttataatgccctgcaactctaaaccatccttttgtttacacatttttgtatggtattttaagattatcaatcacttcaacatttctataaccttgtttgtatagcactttctcaagagctgtcagtcccacatacagaatcatttcttttacaaaatgatttaatatgtaatcatgtgtcaggacataaattttgtcacttgggacagtagctttccagctaagataattgcgtgaactctgttaaaactgattatcactcatcaatggctttatttttaacctataaataacccctttcaatatacctggtttttacagcattgcaaaatctgtaaaaataacttttattggaaaatgtcatgaagtcatttttcattatttgtactaaacaatgttttatgtactccttttgtgttttatcttttgtttttccatctgtactcccctcatcctcctaatgttgagaaaatcaaatttcctgggtgtgtccttgttaagtgatcaaaagtaaatgttctctttgccattttagatggaaaaataaaaaaaattaaaaagtaaatttttgcttttcattatattgaaatgatctggcattatctatttcacagtaatgtaaaatgcttatttttatgtcaccagttgtcaccactcccattgctgatagtgacataggttttgggggcaaaattcagttcctaacaaacagtggatactgctaatgagtcatcttttctactctcttcaattttctactctctactctcctctttaatttttgcacaaaataatactttgcaacaaatagtcttttgtctttattggcagaaaaatcacttgttatatgtgttctagttagttctttttcatgttagctgtgtggctaaaagcgtgttacctttctatatttaaaaaaagtaatctctgaggatagttacagttcctgtaatataattttatgtacctagttttatctttttttaaataagaactgaagagagagctttgttacatatttgaatttttaatttgcactgctgtattttaaacctaaccataattagtcatttaaaataattaagtaggcctgaaagtcagccatgttaatttctcaatttaatcaattcttaaagccttcaaaaattgacattttttttccaagacccttcattctcttaaataactttaattttatgaaaccatgtatactaaagaaaaacttttccaagattccaggtgattgtgcatttgtgctctaatctacttttttaacattacggctaatcttttgcgtagacatatcgctgtggaataactgccatatttcagagttcctcaggtttccttttccttttccagtctctgtctatgaattaaatagtatatagaatgacccatataaggcaatatagttaaataaaaccaggttaaatgatttcctttgtatctgcccaaagttgatagcacacgttactttttcaaaataaagctaaaactaccaaaaagaggatgaaaactttttcctcattatggagtgaagttctaggtggttgctttagaagttggcagtgcagtgctcagaaggaactctcaataaataacatgtactccttggacctgtgagttttaggaaactggaccttttctgaagaccttagaatagggagttggccttaggacctaatgtcccaacttagtgttggacccttttaatataagatattgttaattattagcatacttttcaaaacctttgaaatagttactgctaacctgataaaatgttcccattaatctatcattagtctgtttctctgaaaacaaaatgcattgatgaggtgaaagcttgttccacatggcacctacctaatgaacaggacttactcagtttttaactgttaagaatgtcacatgtactattgtcactccttaggttttcagctataaaacatgtaagtctctcatcatacagatgaattcatttgctaacaaaatatttaaaacccgcagtagactctgaaatatccagtcatcaaactcctggctaactggatgatttggctataataatctttattattattattttcatctgtctctcgaaatatctacagtaggatgttagtaaatggtcttttaaaagcaaaaaattggggataaaaggaaaactgaattccttctatatttttattactaataaataatgcttttgtaaatttgaatggaaaaccacttgtatgtattgctatttggttgcagttacactctggagcttaatttaaaacactactctaaaaatttcatgaaggatgaattccaataatcagaaaataaatgcatttcaaagctaaaa

SEQ ID NO: 173091 - DNA, 1385 bp, Homo sapiens
  Payload ID: 14021
  Gene Symbol: RAB24
  Gene Name: RAB24, member RAS oncogene family
  ENST ID: ENST00000303270
  CDS Start-End: 604-1128
cctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacgtgagtgcatccggaggggccaggcacggtgggcgggggagtggggggccggtaatctgcacctatggccccgatctcttccctctcgttgcagaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacaatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggctttt

SEQ ID NO: 173092 - DNA, 1311 bp, Homo sapiens
  Payload ID: 14021
  Gene Symbol: RAB24
  Gene Name: RAB24, member RAS oncogene family
  Uniprot ID: Q969Q5
  ENST ID: ENST00000303251
  CDS Start-End: 421-1032
tcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggttggcgccgtttggggtcggggtctgaggcttgggcgctgcctgggccgagcggagatcggggtttgcctcccgtccccgctcaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacaatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgc

SEQ ID NO: 173093 - DNA, 1236 bp, Homo sapiens
  Payload ID: 14021
  Gene Symbol: RAB24
  Gene Name: RAB24, member RAS oncogene family
  Uniprot ID: Q969Q5
  ENST ID: ENST00000393611
  CDS Start-End: 333-944
ccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgtaggaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcaggctctgagcgctatgaggccatgagtagaatctactatcggggtgccaaggctgccatcgtctgctatgacctcacagacagcagcagctttgagcgagcaaagttctgggtgaaggaactgcgcagcctagaggagggctgccaaatctacttatgtggcaccaagagtgacctgctggaagaagaccggaggcgtcgacgtgtggacttccacgacgtccaggactatgcagacaatatcaaagctcagctctttgaaacatccagcaagacaggccagagtgtggacgagctcttccagaaagtggcagaggattacgtcagtgtggctgccttccaggtgatgacagaggacaagggcgtggatctgggccagaagccaaacccctacttctacagctgttgtcatcactgagtcagcactcacctggcctgggggaattaaaggaattccccgtaagggctggacccagctcctttctgggcttgggtagtcaaatgtctgagctaccccaggtcctcatgtcagcagagtggcgcctgcctgtgctggcccatggaacggagacagcattgggctgactgtgggcatgaggagggataaggctgatttggaccccaggcttctgccctggacagcacttgtgtctgcagattatttaagtggcttttgatctgtaaataaaatcagtgcactgtgcatcaca

SEQ ID NO: 173094 - DNA, 563 bp, Homo sapiens
  Payload ID: 14021
  Gene Symbol: RAB24
  Gene Name: RAB24, member RAS oncogene family
  ENST ID: ENST00000504395
  CDS Start-End: 367-563
gaccttgcggccccgccccctcgccctctagccccctcccgcgggagtcgcggcgctgcgggtaggagccgggttgcgggagaccccaggttcggttgggattcccagccagaacggagcttaagccgggcaggcgagcgaatgacggagtagcgagctgcacggcggcgtgctgcgctgttgaggacgctgtcccgcgcgctcccaggccgccccgaggcttggggtcttcgaaggataatcggcgcccggggccgaacagcgggggcacacggggcgctgccgaagtgcaaggccacggccagagctcgagcccgacgcgctgtctggagtcgaccctgacgtggctgaagcggccccgggagcatgagcgggcagcgcgtggacgtcaaggtggtgatgctgggcaaggagtacgtgggcaagactagcctggtggagcgctacgtgcacgaccgctttctggtggggccttatcagaacaccatcggggccgccttcgtggccaaggtgatgtcggtcggagaccggactgtgacattaggtatttgggacacagcagg

SEQ ID NO: 173095 - DNA, 1110 bp, Homo sapiens
  Payload ID: 14022
  Gene Symbol: RAB25
  Gene Name: RAB25, member RAS oncogene family
  Uniprot ID: P57735
  ENST ID: ENST00000361084
  CDS Start-End: 242-883
ctcagcttccgtcctctctgcttccttacagcacccccacctgccagagctgatcctccctaggccctgcctaaccttgagttggcccccaatccctctggctgcagaagtccccttacccccaatgagaggaggggcaggaccagatcttttgagagctgagggttgagggcattgagccaacacacagatttgtcgcctctgtccccgaagacacctgcaccctccatgcggagccaagatggggaatggaactgaggaagattataactttgtcttcaaggtggtgctgatcggcgaatcaggtgtggggaagaccaatctactctcccgattcacgcgcaatgagttcagccacgacagccgcaccaccatcggggttgagttctccacccgcactgtgatgttgggcaccgctgctgtcaaggctcagatctgggacacagctggcctggagcggtaccgagccatcacctcggcgtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctgaaaacaatggactgctcttcctggagacctcagccctggactctaccaatgttgagctagcctttgagactgtcctgaaagaaatctttgcgaaggtgtccaagcagagacagaacagcatccggaccaatgccatcactctgggcagtgcccaggctggacaggagcctggccctggggagaagagggcctgttgcatcagcctctgaccttggccagcaccacctgcccccactggctttttggtgccccttgtccccacttcagccccaggacctttccttgccctttggttccagatatcagactgttccctgttcacagcaccctcagggtcttaaggtcttcatgccctatcacaaatacctcttttatctgtccacccctcacagactaggaccctcaaataaagctgttttatatcaatgcctggtca

SEQ ID NO: 173096 - DNA, 1019 bp, Homo sapiens
  Payload ID: 14022
  Gene Symbol: RAB25
  Gene Name: RAB25, member RAS oncogene family
  ENST ID: ENST00000615862
  CDS Start-End: 211-981
cacccccacctgccagagctgatcctccctaggccctgcctaaccttgagttggcccccaatccctctggctgcagaagtccccttacccccaatgagaggaggggcaggaccagatcttttgagagctgagggttgagggcattgagccaacacacagatttgtcgcctctgtccccgaagacacctgcaccctccatgcggagccaagatggggaatggaactgaggaagattataactttgtcttcaaggtggtgctgatcggcgaatcaggtgtggggaagaccaatctactctcccgattcacgcgcaatgagttcagccacgacagccgcaccaccatcggggttgagttctccacccgcactgtgatgttgggcaccgctgctgtcaaggctcagatctgggacacagctggcctggagcggtaccgagccatcacctcggcgtactatcgtggtgcagtgggggccctcctggtgtttgacctaaccaagcaccagacctatgctgtggtggagcgatggctgaaggagctctatgaccatgctgaagccacgatcgtcgtcatgctcgtgggtaacaaaagtgacctcagccaggcccgggaagtgcccactgaggaggcccgaatgttcgctgaaaacaatggactgctcttcctggagacctcagccctggactctaccaatgttgagctagcctttgagactgtcctgaaagaaatctttgcgaaggtgtccaagcagagacagaacagcatccggaccaatgccatcactctgggcagtgccaggctggacaggagcctggcctggggagaagagggcctgttgcatcagcctctgaccttggccagcaccacctgcccccactggctttttgtgccccttgtccccacttcagccccaggacctttccttgccctttggttccagatatcagactgttccctgttcacagcaccctcagggtcttaaggtcttcatgccctatcacaaatacctcttttatctgt

SEQ ID NO: 173097 - DNA, 1675 bp, Homo sapiens
  Payload ID: 14023
  Gene Symbol: RAB26
  Gene Name: RAB26, member RAS oncogene family
  Uniprot ID: Q9ULW5
  ENST ID: ENST00000210187
  CDS Start-End: 161-931
ggcgcgagccgggcgcccgggatgatgccgccgccgccgccgccgccgccgccgccgccaggggaagggttcgggtccgggtcgggctcggcgggcgcggggtgcgggacggcccagggcacggcggctgcagcgggagcacactgagcgcccgcccgccatgtccaggaagaagacccccaagagcaaaggggccagcacccccgctgcctccacgctgcccaccgccaacggggcccgaccggcgcgctccgggactgcgctttccggccccgacgcgccgcccaacgggcccttgcagcccggccggccctcgcttggcggcggtgtcgacttctacgacgtcgccttcaaggtcatgctggtgggggactcgggtgtggggaagacctgtctgctggtgcgattcaaggatggtgctttcctggcggggaccttcatctccaccgtaggcattgacttccggaacaaagttctggacgtggatggtgtgaaggtgaagctgcagatgtgggacacagctggtcaggagcggttccgcagtgttacccatgcctactaccgggatgctcatgctctgctgctgctctacgatgtcaccaacaaggcctcctttgacaacatccaggcctggctgaccgagatccacgagtacgcccagcacgacgtggcgctcatgctgctggggaacaaggtggactctgcccatgagcgtgtggtgaagagggaggacggggagaagctggccaaggagtatggactgcccttcatggagaccagcgccaagacgggcctcaacgtggacttggccttcacagccatagcaaaggagttgaagcagcgctccatgaaggctcccagcgagccgcgcttccggctgcatgattacgttaagagggagggtcgaggggcctcctgctgccgcccttgaacctggctgagctcagtcctctggaggaagccgtccagtccctagaaggctggacagagggtctccaggcccttctgactttgttgcccagtggccaacgcccgagtgtctgttttcaggagccccaggtcaagccttgtcccttcctcctcccagcaacagtcccaacaagcaggcttctgagagcccgtggccgcacactggccgccacggaaaagcagtcttctgcacgggacggggagcggcaagtggacagactttgccacggtgctctgctgccccctcctgggcacgtccaggtgagggagggctggggctggcaccacgcacagtgcctaaccctagaaaagccatgtcttcagccgcacatgctcaggcagctaagggaggacgcctgcccacgcctgggacagaaggcttcactgctaatcacatcgtgcatctgtgtgtcctgggagctgcctgctcccggcccaccctctaggaggctctggctcaaacagcaatagggtcttcctcactgaccttggaggatgcctgtggccttgtgataaaatgtgggaaatcacagaaaacaccagaaacaacaactgccagcccggcctggccacaggtgaggtctgtgatttccgagcacgctccaccttgcactcaacttggccttttgattgcacaagcctttgttttcagtcctagtgaataaagttgtgttttctggagcgtctgtctcatctgttgaaaaaa

SEQ ID NO: 173098 - DNA, 944 bp, Homo sapiens
  Payload ID: 14023
  Gene Symbol: RAB26
  Gene Name: RAB26, member RAS oncogene family
  Uniprot ID: Q9ULW5
  ENST ID: ENST00000541451
  CDS Start-End: 372-944
gtgtgtttgccaagccagggctggagcttcctggacccgcctaccctggaggggatggagcagtgaagggcaccgggccaagcgctaggcatctggggctaaggagacagaagcccgcggtgcccgtccatgcgggccctctgccccagcacccacatctcaggacaccccttcctcccaggaagaagacccccaagagcaaaggggccagcacccccgctgcctccacgctgcccaccgccaacggggcccgaccggcgcgctccgggactgcgctttccggccccgacgcgccgcccaacgggcccttgcagcccggccggccctcgcttggcggcggtgtcgacttctacgacgtcgccttcaaggtcatgctggtgggggactcgggtgtggggaagacctgtctgctggtgcgattcaaggatggtgctttcctggcggggaccttcatctccaccgtaggcattgacttccggaacaaagttctggacgtggatggtgtgaaggtgaagctgcagatgtgggacacagctggtcaggagcggttccgcagtgttacccatgcctactaccgggatgctcatgctctgctgctgctctacgatgtcaccaacaaggcctcctttgacaacatccaggcctggctgaccgagatccacgagtacgcccagcacgacgtggcgctcatgctgctggggaacaaggtggactctgcccatgagcgtgtggtgaagagggaggacggggagaagctggccaaggagtatggactgcccttcatggagaccagcgccaagacgggcctcaacgtggacttggccttcacagccatagcaaaggagttgaagcagcgctccatgaaggctcccagcgagccgcgcttccggctgcatgattacgttaagagggagggtcgaggggcctcctgctgccgcccttga

SEQ ID NO: 173099 - DNA, 857 bp, Homo sapiens
  Payload ID: 14023
  Gene Symbol: RAB26
  Gene Name: RAB26, member RAS oncogene family
  ENST ID: ENST00000565592
  CDS Start-End: 151-345
gcatcaaatcttgaaaccagatcaaaactgaagctcccacaagcacagcctaattcagggactcccacctgagtagagaggccggaagaaccatccgcagagggtcacaggacagctggacaccctgacagcccagatcactgaaaggtcatgctggtgggggactcgggtgtggggaagacctgtctgctggtgcgattcaaggatggtgctttcctggcggggaccttcatctccaccgtaggcattgacttccggcagggtctcactctgtcgccctggctggagtgcagtggtgatcatggtggactgcaacctccaacttctgggttcaagccatcctgagtctttcaaattagcaaaaagagctactgggaaggctgaggcgttgcagctcgttagttactgcacccatttgcagatgaggaaaccgaggcagtgtcaaacaaagttctggacgtggatggtgtgaaggtgaagctgcagatgtgggacacagctggtcaggagcggttccgcagtgttacccatgcctactaccgggatgctcatgctctgctgctgctctacgatgtcaccaacaaggcctcctttgacaacatccaggcctggctgaccgagatccacgagtacgcccagcacgacgtggcgctcatgctgctggggaacaaggtgggaggcccggctgtcctcacctgggccacagggcagggcaggtgagggggcaggggccaaccatgggccagctttcaccaagaccctgtgcctgggccaggtggactctgcccatgagcgtgtggtgaagagggaggacggggagaagctggccaaggtgagtcagggcaggggggtggtga

SEQ ID NO: 173100 - DNA, 644 bp, Homo sapiens
  Payload ID: 14023
  Gene Symbol: RAB26
  Gene Name: RAB26, member RAS oncogene family
  ENST ID: ENST00000566724
  CDS Start-End: 1-409
caaggagtatggactgcccttcatggagaccagcgccaagacgggcctcaacgtggacttggccttcacagccatagcaaacaacagtcccaacaagcaggcttctgagagcccgtggccgcacactggccgccacggaaaagcagtcttctgcacgggacggggagcggcaagtggacagactttgccacggtgctctgctgccccctcctgggcacgtccaggtgagggagggctggggctggcaccacgcacagtgcctaaccctagaaaagccatgtcttcagccgcacatgctcaggcagctaagggaggacgcctgcccacgcctgggacagaaggcttcactgctaatcacatcgtgcatctgtgtgtcctgggagctgcctgctcccggcccaccctctaggaggctctggctcaaacagcaatagggtcttcctcactgaccttggaggatgcctgtggccttgtgataaaatgtgggaaatcacagaaaacaccagaaacaacaactgccagcccggcctggccacaggtgaggtctgtgatttccgagcacgctccaccttgcactcaacttggccttttgattgcacaagcctttgttttcagtcctagtgaataaagttgtgttttctgga

SEQ ID NO: 173101 - DNA, 3446 bp, Homo sapiens
  Payload ID: 14024
  Gene Symbol: RAB27A
  Gene Name: RAB27A, member RAS oncogene family
  Uniprot ID: P51159
  ENST ID: ENST00000336787
  CDS Start-End: 243-908
gcggaaaatacccgccaacgacccaaaaaaggccggcggcgggtggacgcggcgcgcgaggacccgagccaggcggggacaggacggcggggcgagccagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaaaaaaaaaaaaaaaaaaaaatgggctgggcgtggtggtgggcacctgtagtcccagctactcaggaggctgaggcaggagaatggcgtgaacctgggaggcggagcttgcagtgagccgagattgcgccactgcactccagcctgggcgacagaggagactctgtctcaaaaaaaaaaaaaaaaaaaaagagcagggtcataatcacacagcagtgccttatatagttgccataagacttcagtgcagtacaacataattttacagctacatatcagggcatattctatatggtgtatttgtgttagaataacacattaaatgtctttaaacataaaaataagaatgtttgcatgtttcagttttcaagaaccaaatgagtaattagctatagattccactggccttaaacatacaattaagtgtatacatgatatagtgcacacacaaaagccacctttaattattgaaataacctgtattctttttggaaatcatttaagtttggtattgaagtactatattttttgtgcatcaatgtatttttctatttacaagcctatgtaaaagtgaagtgtatcttcagtgaaccatgtgccaattaagctgtaataaaaaagtggtctagtctgtc

SEQ ID NO: 173102 - DNA, 3459 bp, Homo sapiens
  Payload ID: 14024
  Gene Symbol: RAB27A
  Gene Name: RAB27A, member RAS oncogene family
  Uniprot ID: P51159
  ENST ID: ENST00000396307
  CDS Start-End: 253-918
gatgcctgttttgaaagttgatggagcgaactgcttttccaaagactcttttgaaaaactttttaagtaggccattctgactttaacatttctctttgtcttaacattagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaatttgttgcagctttgtaaatatttctttaagattcagcctgagagttaggagaaatatttcagagccaaaagtgccttatacaaccttagcctattatagtaaatcattcaaggattcagaattttgcagtcacagaagagtgtatttattatgtagaatgaatgagggtactgtcacctgccttaatgtaggtaggcccagagtcttacatttaagatcttacatgcagttataaaaccgccacagtcttcaatccagatttgaagactcatgccataggtgacattctaaaataccattaaagccacttaaatgttaaataagaatatacatgcacatcagctcaatgtctttgagtattaattttatgtaagcattctatttaacatgaatataggacaaatcatggctatatctatagaccttggataaactggattgaccaattatacactcacggtgacttttttattggtgggaaggggattggggtggggcaggctggcttaatgtaatatgagcaaccaaagtgggacttctgtctccccgctatattcccattgctctgaatggttgattgaagggtcagggaactagattttatggctttagttcactgtgattgtacatttatacttggcctatgtgctggccgcacctgaacatagctggtgcttatgccgagttatttgcgatgagtaaatatttagtttctttttcttcatatttataatgttgatctggcatcctcaggctgcagctttattagcttataacttactcatctctatctttaccagcaggctctgtattgttgatatttgcaacttgttttgcttttccattggtggaattgaaataattagtttttaattacataagatgcctgtttgctatttggtggaagatagatgttcatattgaagcagtcacatttgtactgtagttcaataaaagaaaaatgaagtattctgtagcctatatttttcatagagctcatgagcatttactgtacttgctgggtcttgccaagatcatttattccgctgcattgccaaagtgtcttcataccaaattaaaggtggttttaatatatgtttcatggaagttgtttataaaattcaaaggtatttcatttaggtgaaaagtcttatttattaaagtggtttgaataaagtagatcaaaacttccagagatcttaatggctatataggaagaaatatcactcaccataatttaaataaagaataaaaatacttgtattttgtggtggcaaatgtttggtagaactgtaattagaaaaatacaagtatatttgcgtgatggttacactagaagcccagactttacgactacacaatatattcatgtatctaaactgtacttgtaccccctaaatttatttttaaaaaaggaaaaataaaagtatcatgaaaaaacctatttttttttccactgtccttccactactcccataacaaacttatccatggttggtaaaattttacatatttctatccttgaaatgaaggcttcttttaaattccaaagaagtcatggaggcctgtgcatttgaattgtatatgctagtgaggaaaagatttagacatttcaagagcagggttggccaggcgcggtggctcacacctgtaatcccagcactttgggaggccgaggagggcggatcacgaggtcaggagatcgagaccatcctggctaacacagtgaaaccccatctctactaaaaaaaaaaaaaaaaaaaaaatgggctgggcgtggtggtgggcacctgtagtcccagctactcaggaggctgaggcaggagaatggcgtgaacctgggaggcggagcttgcagtgagccgagattgcgccactgcactccagcctgggcgacagaggagactctgtctcaaaaaaaaaaaaaaaaaaaaagagcagggtcataatcacacagcagtgccttatatagttgccataagacttcagtgcagtacaacataattttacagctacatatcagggcatattctatatggtgtatttgtgttagaataacacattaaatgtctttaaacataaaaataagaatgtttgcatgtttcagttttcaagaaccaaatgagtaattagctatagattccactggccttaaacatacaattaagtgtatacatgatatagtgcacacacaaaagccacctttaattattgaaataacctgtattctttttggaaatcatttaagtttggtattgaagtactatattttttgtgcatcaatgtatttttctatttacaagcctatgtaaaagtgaagtgtatcttcagtgaaccatgtgccaattaagctgtaataaaaaagtggtctagtctgtcaaa

SEQ ID NO: 173103 - DNA, 663 bp, Homo sapiens
  Payload ID: 14024
  Gene Symbol: RAB27A
  Gene Name: RAB27A, member RAS oncogene family
  ENST ID: ENST00000566877
  CDS Start-End: 107-663
actctgcatactgaataataggtgaaataaggaaagactttgagaagcaataagaaatatatctgatttgaccttgtccattaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatgga

SEQ ID NO: 173104 - DNA, 1057 bp, Homo sapiens
  Payload ID: 14024
  Gene Symbol: RAB27A
  Gene Name: RAB27A, member RAS oncogene family
  Uniprot ID: P51159
  ENST ID: ENST00000564609
  CDS Start-End: 234-899
agacaaaaagtaaccttcctgaagaggacatgtgattggaagttgtcaattgttgaagcattggtaactccagtctctaacgttttagaaaatcataacaagcggttctctaccctgtaaagaacagaaacctggaaatctaaggctcaaagacatccaagtaattggtatctgggagatttgggattcaaacccagctctgcttgacttggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaattaa

SEQ ID NO: 173105 - DNA, 1013 bp, Homo sapiens
  Payload ID: 14024
  Gene Symbol: RAB27A
  Gene Name: RAB27A, member RAS oncogene family
  Uniprot ID: P51159
  ENST ID: ENST00000569493
  CDS Start-End: 194-859
cacaggaagagaagtgggtttgaagcaaggttgtggagaaaagcaaaggagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggaggaagccatagcactcgcagagaaatatggaatcccctactttgaaactagtgctgccaatgggacaaacataagccaagcaattgagatgcttctggacctgataatgaagcgaatggaacggtgtgtggacaagtcctggattcctgaaggagtggtgcgatcaaatggtcatgcctctacggatcagttaagtgaagaaaaggagaaaggggcatgtggctgttgagaagtcaagtaagcgacatagtagttcaggtggcccatgcctgggatcttctctatgattgatacatggcacagtgagagattaatgggcattgtgtacaaattgcttctcaccatccccattagacctacgaataaagcatccggttctaaaa

SEQ ID NO: 173106 - DNA, 809 bp, Homo sapiens
  Payload ID: 14024
  Gene Symbol: RAB27A
  Gene Name: RAB27A, member RAS oncogene family
  ENST ID: ENST00000565972
  CDS Start-End: 402-809
gagaagtgggtttgaagcaaggttgtggagaaaagcaaaggagacaaaaagtaaccttcctgaagaggacatgtgattggaagttgtcaattgttgaagcattggtaactccagtctctaacgttttagaaaatcataacaagcggttctctaccctgtaaagaacagaaacctggaaatctaaggctcaaagacatccaagtaattggtatctgggagatttgggattcaaacccagctctgcttgacttgaggctctgcccttatccacgggctagccatacctgaaacgtgaggttgcagatctgcactgaagcactctgaggaaacacactgcagtggcttttggggctcagcattcaggagttttcagcataaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgat

SEQ ID NO: 173107 - DNA, 432 bp, Homo sapiens
  Payload ID: 14024
  Gene Symbol: RAB27A
  Gene Name: RAB27A, member RAS oncogene family
  ENST ID: ENST00000568803
  CDS Start-End: 218-432
tgtgattggaagttgtcaattgttgaagcattggtaactccagtctctaacgttttagaaaatcataacaagcggttctctaccctgtaaagatttatgtgatcccaatgcaatgcaatgcaattccaataagaatccccatatggtttttgaggaactcagatggaaatgtgaagggttcatgtccttggtaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagtt

SEQ ID NO: 173108 - DNA, 702 bp, Homo sapiens
  Payload ID: 14024
  Gene Symbol: RAB27A
  Gene Name: RAB27A, member RAS oncogene family
  ENST ID: ENST00000563262
  CDS Start-End: 417-702
cccgacgtggtggcctccttgcggtttcctttcgccgtttccgaaccgagggattgctactcgcctttggcttggcggtctctgtgctcgggggtccgaaaactgctggaaggcccccggtctctggaggggagcaggcggtagcgagtttagtgacgtggagcaggcgcagaacagtcggagatacagtctcgctgtgatgcccaggctggagtgcaatggcgtgattttggctcactgcaacctctcccacccaggttcaagtgattctcctgcctcagcctcccgagcagctgggattacagaacagaaacctggaaatctaaggctcaaagacatccaagtaattggtatctgggagatttgggattcaaacccagctctgcttgacttggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttc

SEQ ID NO: 173109 - DNA, 701 bp, Homo sapiens
  Payload ID: 14024
  Gene Symbol: RAB27A
  Gene Name: RAB27A, member RAS oncogene family
  ENST ID: ENST00000567380
  CDS Start-End: 262-701
gagaaaagcaaaggaggtgagtacgggacatgctggatttgagatgccagcaagatatctgggtggactcccttgtaggcagttttacttatgaaattggaggccagctgcaaggtctgacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatgtctgatggagattatgattacctcatcaagtttttagctttgggagactctggtgtagggaagaccagtgtactttaccaatatacagatggtaaatttaactccaaatttatcacaacagtgggcattgatttcagggaaaaaagagtggtgtacagagccagtgggccggatggagccactggcagaggccagagaatccacctgcagttatgggacacagcagggcaggagaggtttcgtagcttaacgacagcgttcttcagagatgctatgggttttcttctactttttgatctgacaaatgagcaaagtttcctcaatgtcagaaactggataagccagctacagatgcatgcatattgtgaaaacccagatatagtgctgtgtggaaacaagagtgatctggaggaccagagagtagtgaaagaggagga

SEQ ID NO: 173110 - DNA, 7281 bp, Homo sapiens
  Payload ID: 14025
  Gene Symbol: RAB27B
  Gene Name: RAB27B, member RAS oncogene family
  Uniprot ID: O00194
  ENST ID: ENST00000262094
  CDS Start-End: 522-1178
agcgccctgggctctttgaatgagagacatcaaagaaaacacagaacaaaaatgaataaaaatgagctcgctggtaaggctagaagccccacagtgtggagacttcatccccgagaggagtgtgtttctcactgcagcagttgagtcaccagcaagacttgcctgaggtgagctccgcacatccgcgttgggacttgcagacacgccttcttctcacacaaaccttacccagccccgccgccgcggcggactccgagggtggtgccaccagccctgccactcgcagtcctgacgggcaggggctgcggaccgcccggccttggacccatccggagccacaggttggaggagataagtagctgtccccgtgctcatcgccctgtggagcagatcctgtctccttgctgacggtggagcccgggagttccagggcttgggaaggggaaggaaacctctctgaaatctgacacctgctctcccggcaaggaaacttcgcaggctgaccgaccaagaccatcactatgaccgatggagactatgattatctgatcaaactcctggccctcggggattcaggggtggggaagacaacatttctttatagatacacagataataaattcaatcccaaattcatcactacagtaggaatagactttcgggaaaaacgtgtggtttataatgcacaaggaccgaatggatcttcagggaaagcatttaaagtgcatcttcagctttgggacactgcgggacaagagcggttccggagtctcaccactgcatttttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggcataccatattttgaaacaagtgcagcaactggacagaatgtggagaaagctgtagaaacccttttggacttaatcatgaagcgaatggaacagtgtgtggagaagacacaaatccctgatactgtcaatggtggaaattctggaaacttggatggggaaaagccaccagagaagaaatgtatctgctagactctacatagaaactgaacatcaagaaccccaccaaaatattacttttaaaaacaatgacaaaccacacaattgttgttgagtaaaccacgcacaatggcatgtctttctttttctgccagaaaatctattttaagaaaccagaatagtcaacagtgttcaaaagaattgactagttatccctgaggccctttcaaacatgatcaaagatttcccaatgtgatctcatcatcatggatactcaatttgttttttcttatagagaaaatgagtatataagacaatatacaagaagaaatatcagtgagttttaaatcagaacaagttacctgtcacattgaagaaaagggtaggcactaaagggagaacacagaaagaagaatttctaaaatattggatttacttcttatattgagtcagatgcatacttttagatttgcattggggaaaatgtactagctaaaaatggatacacaatgaagaattctatttggctaattaagaatgatatactatgtacacccaataagctgtactagaatgaataaattactgataaggttacaaataggtaaatgtcacacttctgttaaaatgcaggaggtagtgtcataatgccgtctttatattcttaataaatagcactttgacaagaacaggactgtaaatgatgaagtacaagacaaataccctgggaaaaaaaatgaaagtatgagaaattggcatttctacagctgaaattcaatgtatctgttagagatgtctggaagggttacttagccaaattttactcaagccaattaggagctgatattatcagttggaattaagagaactccagaggtttccatttcaaacaaaattttagaaattggtttggtgttcagcttcacatttcattttttcttagcacatgttgataaaatagtcacaaggagaaattaccagttacggtttattaaatctcttttaaaatgcagtcaaggaaaactagccttgaattttttttagataaaataagatggtgatatgaaacaaaaagtggcaattattgcaggtttccttttagtttacaaaagtactggaaactaaatcatatttcttccctccaaatttcacccattcctgactttgaatcaattgcagaaatgcaggtgtgttactttgttgatcaataactttggaacaattatggatcaattctatggtcactctgaattttcatgtcattaatcacataaaaattgataatacctcattctgtattacaatatgattttattttgccaaaggcaagacacctatagttgagctgtattttgggggattgggtgaggaaggacttctgatcttatctcaacaaaaaactggccagtatttttgttaatgtaaagcttccttttctttctaaaaaatagtaacaaaattatttttcattggcctattctgttcttgtgtctaaactaacattacattaatttttaatcttagtttctgataaacacaagccattcctatcaaaatattatttatttcagtcaattttaccaaataacaaagacaatatattttcgtttttttttattatgagcatatgattttttgacaggctgtttcctcgtcgtatagattttttccaatcaaacctactttttccatactctgtgcatattttttgtgaagttatacacattgaagaccctaaaaatcccagtccatcattcagcttacctctgcgaacttctatctggtattgaatcagtttcagaaacacagacagatccaaggaaatgtctctttataatgttcttaggatggactagacccataaatgtgccatgaatcaaaatattaataatttgaaagctttcatgctgttagcccctgatgaaattctcagcattaactggccagctcctctgatttctgcagcatcgcaacaggttcgaagatgggttgtggctgggtattccctcccatggtgtttcctctgggatgctcttcattatctcaatgcctgtgccatgaagatagaaaactgtaagctaacatttaagatgtttcttctggaaggaaagtgagcaggaacaagttatattgccactgctgtggcaaattttggtgaacttttggggtcattatatcaattttttctttggattcaaattgtaatgtcccctgcatttccttaatagggaatgtgaaacctttataaaactctaaaagtattctgttttgatatgtctttttgtttctattcattttcagttatatgattgatttacttatgccaagattctgtcactgtcagttatttaatgagtgttttttcagggtctgttttaagatcattatttgatagctgtagcatgaagcagaggttgatgatgcccataattgcaagactattcctgtaaaaataacaattattgggtaataacttcaagaggaatgagaagtgacaaaattgatttaaaatattgttctacttataaataaatgcttgatataaaaaattttctccataaagtttgacatctgaccccagattctatgtaatcattattagaaattccttctctcattatttcaggattagtagttctgtgtaattcattttacaatttcaaattgttctggtgccataaagtatacagactactttaaagatttccaaatcccctaatttaccccacaacagcatgtaattttagccaagatatgtcctgttactaagtatctcccaatgctttagtaaaacgtatttaggagaaatgttgaaaatgtacatgaagctcctttctgatatagaaaccatttctggagtatttacactggtttgatgtttacattgctctaactcggtgcctcagatacctctgtgaccaaatttgtctccaaccacatagctcatttcctataatgttatatcataggaagccctcacagagacactaacacagctaaagatcttctgatattatcagcaagggatgcaaggactttattggaatctggagagtttaactgccttctcttggtctcctcacttacttcttatgaagttggcattacctgagactcttagctgtgattaggtacaagcttaccttttagggtagaaaaagaaagatcatttgaaaaatgtatctaaaataatccagagaacataatgtttgtcttggtctgataatgataagaagtcaaggattggcagagaaaatactaaacgccaagagttgagcctgtgggtctctccataagagttttaaaactcttgccagttaccactttatccaatttgctatcattttcgtattatcagctatcgccctgtaaaatattcaaaactagctatttctaaagtaaacattttatctgttacttttaaccagataggtgtctttgtcatccttctactataaattgttctttgccaacctgtacaggtagatgaaccaggcgagagttttaatcagccttttcttgtcccctttgtaagaaagagatgcttgccatagagaaggacatgagtacattaaaaataatttaatagccacaatatgatgttctttaagctgcaaattgagtacactgggaatcaacaaatttgatgaagcctgtctgtctcttcaccagtggagtgagtgcagcagttagaaagagaagcaatattgtgcaactggtgcagtggtgagttaatcatagtgtataaccttgtgttcatgaaacaggttgttcattgttctgcatctctcttcatttaaaaaggatacacaattctttcctcattgcatattacaccaaacgtttgagggaaaaatcctcattcgtaaaggattttggatgtataatctaaaactcaacaataaagaaataatattccaagtctctggtttcctaagatacataataactgtttataaagaaggtctaagagctgatatttgccaaagtgatagaagagttgttttttcctctctactaccaagctttaagacattaaaagaagtctagtgtatttgaatattttagagaaagctttatcattttttaagatgccaagatgctgcctacgtttgcaaaagttgtctaagaattcaccatgagctatattttcttctggatctttgaccaaggtgatgtcagcttatttctggggaaggtgttgagctcttatacatgaaaatggatataggctattctctgggatgagtgtcatttcaatgctttataaatccatgaagctgcttgtctcataaagtagaactgatacaaattttggttggatatatagagaattttataaatgtattgccttagaatttctgggtggagacccaactacaatgacattgtcatgccagaactataaagataattagagttaaaagttgtttaaattgtgcccttaaatacagcagaacctggagaaggtcatacttcaaaggtcgattttgagtccgaataaagaaagacctagtaacagatagtttttttttgttcattttcttctaccaagtagaggtttatgccctcagaactaaactagtaaaaatatctgaacaaaaaacctttcgttgttggcataaaaatgtgatacacttagagacattttgtttattgcatataaatctaatttttccataaattagatttatgatattttcataaagcacttgattagtttttcaaggcgtaccatcacaaagatgctttcctgcagagttctttgtatcaacagcctatggttgagatgttttctcatttcctgtagagagagaataccactaacaaacaaacaaaaactttagtgccaaaatagtggaactattttgtcatcttttgagaaaaaaatatacaaagaagtcatcttttcattaagtggattccctggttcctttccagctggttgtggaagtaatggctaacatccttcagctgactttgtctacaaggattattagcaaattctgtaggagcaagcatgtctgaccttaacttaatggatcccttattcaatcagtggcttctgtctttatgtctgttggcatatcaaaatggtttctgttcctagaaaagtaataacatatgcttatctttattctttttccaggtgattttgttttcaaatgctccttgtgaaaacacctagtgttgtagaaaggaaagtggccagaaagaacaacttgggaccatgagtaggtcattaaatagcttagtgatttatcctcatatagggcttataaaccctgtatgtgtttatatgtgcttcacagagttcgtgtcaggctcaaaggagatatgtataagaaagtggtttgtaaattatgttccatttcataaatagacactattcacaaactaaaatctaataaaaaaccacagttgtaatttaaactgcttgatataaaaagaggtatcatagcagggaaaacacactaattttcatacagtagaggtattgaaaactgaaaatgggaaggcaacttgaagtcattgtatttgattgaaaatgtttaatacatctcattattgacaaaatatgtcatcttgtatttatttcaaggaaaccaatgaattctaggtagtatattacaagttggtcaaaatattccatgtacaaatagggcttctgtgtccatagccttgtaagagatactgattgtatctgaaattattttttaaaaaaataaattatcctgctttagttagtgtgttaaaagtagacgatgttctaatataacactgaagtgcttcattgtatcccaacagtttaccttcaagtaatattatctttatttttaggctaagcacgtttgattattttgtctgtctcctatatagatctgttttgtctagtgctatgaatgtaacttaaaactataaacttgaagtttttattctatatgccccttaatagactgtggttcctgacgcacactgttaggtcattattttgttgtaccaaagttctagtggcttcagaaatcatagcatccaatgattttttggtgtctggctatgaatactatggttgagaattgtattcagtgattgtttctgcacacttttcaaataaaaaatgaatttttatcaatta

SEQ ID NO: 173111 - DNA, 423 bp, Homo sapiens
  Payload ID: 14025
  Gene Symbol: RAB27B
  Gene Name: RAB27B, member RAS oncogene family
  ENST ID: ENST00000592334
  CDS Start-End: 1-394
tttcagagacgccatgggcttcttattaatgtttgacctcaccagtcaacagagcttcttaaatgtcagaaactggatgagccaactgcaagcaaatgcttattgtgaaaatccagatatagtattaattggcaacaaggcagacctaccagatcagagggaagtcaatgaacggcaagctcgggaactggctgacaaatatggctgcaaattgagtacactgggaatcaacaaatttgatgaagcctgtctgtctcttcaccagtggagttgttcattgttctgcatctctcttcatttaaaaaggatacacaattctttcctcattgcatattacaccaaacgtttgagggaaaaatcctcattcgtaaaggattttggatgtataatctaaaactcaacaataaagaaataatattccaa

SEQ ID NO: 173112 - DNA, 432 bp, Homo sapiens
  Payload ID: 14025
  Gene Symbol: RAB27B
  Gene Name: RAB27B, member RAS oncogene family
  ENST ID: ENST00000586570
  CDS Start-End: 171-432
tttgctgttacacaggaagagagcaggcagcatcagtatcggctcagcatccttcccccttctgttcgattagaagctgatcgaagcaacagtgccataaagaaatgggctagatatttccagaggctgcaatctggaggcgtttggaggtaccgaccaagaccatcactatgaccgatggagactatgattatctgatcaaactcctggccctcggggattcaggggtggggaagacaacatttctttatagatacacagataataaattcaatcccaaattcatcactacagtaggaatagactttcgggaaaaacgtgtggtttataatgcacaaggaccgaatggatcttcagggaaagcatttaaagtgcatcttcagctttgggacactgcgggacaagagcggttccggagtctcaccactgcat

SEQ ID NO: 173113 - DNA, 1810 bp, Homo sapiens
  Payload ID: 14026
  Gene Symbol: RAB28
  Gene Name: RAB28, member RAS oncogene family
  Uniprot ID: P51157
  ENST ID: ENST00000288723
  CDS Start-End: 216-878
gtgcgcgtagggggcggggccgcgcgcagagggcggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagggagtcctcttggtatatgatattacaaattatcaaagctttgagaatttagaagattggtatactgtggtgaagaaagtgagcgaggagtcagaaactcagccactggttgccttggtaggcaataaaattgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagcgtattgtcagggcagaaatagtgaagtacccggaagaagaaaatcaacataccacctctactcagagtagaatctgttcagtacagtagtgcagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccgaggacttctaggaacttgttttatcagtgaccatctctgtagttcagttaacactttactcccaacttgcttcatcattgctattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatttaaatta

SEQ ID NO: 173114 - DNA, 1715 bp, Homo sapiens
  Payload ID: 14026
  Gene Symbol: RAB28
  Gene Name: RAB28, member RAS oncogene family
  Uniprot ID: P51157
  ENST ID: ENST00000330852
  CDS Start-End: 216-881
gtgcgcgtagggggcggggccgcgcgcagagggcggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagggagtcctcttggtatatgatattacaaattatcaaagctttgagaatttagaagattggtatactgtggtgaagaaagtgagcgaggagtcagaaactcagccactggttgccttggtaggcaataaaattgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccgaggacttctaggaacttgttttatcagtgaccatctctgtagttcagttaacactttactcccaacttgcttcatcattgctattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatttaaatta

SEQ ID NO: 173115 - DNA, 1787 bp, Homo sapiens
  Payload ID: 14026
  Gene Symbol: RAB28
  Gene Name: RAB28, member RAS oncogene family
  Uniprot ID: P51157
  ENST ID: ENST00000338176
  CDS Start-End: 216-830
gtgcgcgtagggggcggggccgcgcgcagagggcggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagggagtcctcttggtatatgatattacaaattatcaaagctttgagaatttagaagattggtatactgtggtgaagaaagtgagcgaggagtcagaaactcagccactggttgccttggtaggcaataaaattgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagggccatttcattattttcatttcatcaactaatagagaataatcgagtgtgctttgtggctctaaaaataaagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccgaggacttctaggaacttgttttatcagtgaccatctctgtagttcagttaacactttactcccaacttgcttcatcattgctattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatttaaatt

SEQ ID NO: 173116 - DNA, 405 bp, Homo sapiens
  Payload ID: 14026
  Gene Symbol: RAB28
  Gene Name: RAB28, member RAS oncogene family
  ENST ID: ENST00000504644
  CDS Start-End: 1-224
ttgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagggccatttcattattttcatttcatcaactaatagagaataatcgagtgtgctttgtggctctaaaaataaagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccg

SEQ ID NO: 173117 - DNA, 1551 bp, Homo sapiens
  Payload ID: 14026
  Gene Symbol: RAB28
  Gene Name: RAB28, member RAS oncogene family
  ENST ID: ENST00000508274
  CDS Start-End: 182-469
ggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagttgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccgaggacttctaggaacttgttttatcagtgaccatctctgtagttcagttaacactttactcccaacttgcttcatcattgctattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatttaaatta

SEQ ID NO: 173118 - DNA, 193 bp, Homo sapiens
  Payload ID: 14026
  Gene Symbol: RAB28
  Gene Name: RAB28, member RAS oncogene family
  ENST ID: ENST00000510528
  CDS Start-End: 1-155
cacagggagtcctcttggtatatgatattacaaattatcaaagctttgagaatttagaagattggtatactgtggtgaagaaagtgagcgaggagtcagaaactcagccactggttgccttggtaggcaataaaagaaagcagcatggattatgaagaacagcaacacagctgcagattttatgatattgcat

SEQ ID NO: 173119 - DNA, 715 bp, Homo sapiens
  Payload ID: 14026
  Gene Symbol: RAB28
  Gene Name: RAB28, member RAS oncogene family
  ENST ID: ENST00000511649
  CDS Start-End: 1-430
gttggataaatatatctatggagcacagggagtcctcttggtatatgatattacaaattatcaaagctttgagaatttagaagattggtatactgtggtgaagaaagtgagcgaggagtcagaaactcagccactggttgccttggtaggcaataaaattgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagcgtattgtcagggcagaaatagtgaagtacccggaagaagaaaatcaacataccacctctactcagagtagaatctgttcagtacagtagtgcagatgaggaaaatgaggctcagagcaactgaatagcccatctgaggttgtgaactggtgagtgatgggaaagggatgcaaatccaggtctgcctgacttctcacccatcacgttatacgcctcatgctgcagtgaccctctgtcaggttcagagtaagtgcttattacacagtttcaagtgaacgaacaaactgttttcatgactgaatatataaatctgttacacaagtatatatttagaaaaggagcccataaaaataaagaatgaatattttcaatctc

SEQ ID NO: 173120 - DNA, 1679 bp, Homo sapiens
  Payload ID: 14026
  Gene Symbol: RAB28
  Gene Name: RAB28, member RAS oncogene family
  ENST ID: ENST00000630951
  CDS Start-End: 216-503
gtgcgcgtagggggcggggccgcgcgcagagggcggggaggtgggcaagatggcgcttgccgagtgattctcctcgaatacctcctgccggcgcggagacaccggggcgggggtcctgccgcaactacctcccttcctcctctcccccgcccccggagccttcatccttcccttccccccccacctcgaggggcgggcctggttcccgggacaccatgtcggactctgaggaggagagccaggaccggcaactgaaaatcgtcgtgctgggggacggcgcctccgggaagacctccttaactacgtgttttgctcaagaaacttttgggaaacagtacaaacaaactataggactggatttctttttgagaaggataacattgccaggaaacttgaatgttacccttcaaatttgggatataggagggcagacaataggaggcaaaatgttggataaatatatctatggagcacagttgatttggagcatatgcgaacaataaaacctgaaaaacacttacggttttgccaggaaaatggttttagtagccactttgtctcagccaagacaggagactctgtcttcctgtgctttcagaaagttgctgctgaaatccttgggatcaaattaaacaaagcagaaatagaacagtcacagcgtattgtcagggcagaaatagtgaagtacccggaagaagaaaatcaacataccacctctactcagagtagaatctgttcagtacagtagtgcagagggtggtgaaggcagatattgtaaactacaaccaggaacctatgtcaaggactgttaaccctcctagaagctctatgtgtgcagttcagtgagcgcatttttcttttgtgttgatagttctggctgcccttcacctctgggtgggcccgaggacttctaggaacttgttttatcagtgaccatctctgtagttcagttaacactttactcccaacttgcttcatcattgctattgcctcacagtggcaggcagctccttggatttgaaagaattcaactttgggaccacacactttgaattcaaaatggaaaacccattccctggaattagactgcttcattgcaaaagaatgatgttgtttctttgtatgtccttgcttcttttttcattgatgtaaatttttttaacttaatatgaaaactctccaagtcttgatcatcagccaggattttgccacagcaatttcattctcttatcggaacttgtatgtgtcaaagtatacttcagagtgcaaacattaagcaagtaatatattttacctacagatacttatgaagacattctttcgctatcgtgagtaaaagtatataaagctgtttctaactgaaaatgcttgaaataagcctgtaatagaaatattttttcattttttaaaaaagggcctaaattgtttatattgtagtttgtaactcacaaagtaatatttgatattgtatttttattactgtatcgttgtcgttatgtattgtgtaatactcaggtttgaaggctttctgaattctgataaatgttcagctgatgctccacgtggaatttctcttgcaaactgcataagagtactcccgagaatgagttatgacattgtggatcagactgtacctgatgttcagatgtttttctttcacaaataaacttatttaaatt

SEQ ID NO: 173121 - DNA, 1723 bp, Homo sapiens
  Payload ID: 14027
  Gene Symbol: RAB29
  Gene Name: RAB29, member RAS oncogene family
  Uniprot ID: O14966
  ENST ID: ENST00000235932
  CDS Start-End: 207-818
ggaggaaggggagagagaggcgcgcgggagggcgtctagggaatcgaggtgccggctgctccttcctcacaatttgcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgacaattttattaagtacatttgaattgtctcctgactactgtccagtaaggaggcccattgtcacttagaaaagacacctggaacccatgtgcatttctgcatctcctggattagcctttcacatgttgctggctcacattagtgccagttagtgccttcggtgtaagatcttctcatcagccctcaatttgtgatccggaattttatgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggagggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaa

SEQ ID NO: 173122 - DNA, 3272 bp, Homo sapiens
  Payload ID: 14027
  Gene Symbol: RAB29
  Gene Name: RAB29, member RAS oncogene family
  Uniprot ID: O14966
  ENST ID: ENST00000367139
  CDS Start-End: 305-916
ggaaggggagagagaggcgcgcgggagggcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccgcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgacaattttattaagtacatttgaattgtctcctgactactgtccagtaaggaggcccattgtcacttagaaaagacacctggaacccatgtgcatttctgcatctcctggattagcctttcacatgttgctggctcacattagtgccagttagtgccttcggtgtaagatcttctcatcagccctcaatttgtgatccggaattttatgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggagggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacacgtaggcacttagtcataggaaacatattatgtgcaggtcctagcctgggggaggaaagtagatagacagaaaatcattaggtaatttaagtactaaattgggcagggctttttagtatcaaatcactactagaccatttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccagccgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggagactgaggcaggagaatcgcttgaacctgggagttagaggttgcagtgagctgagatcacaccattgcgcttcagcctgggcaacaagagtgaaactccatctccaaaaaaaaaaaacaaaaagaaaaagatttttgggtcccgacctcaaacctactgaatcagaatttctagggatgaagcctaggaatgtgttgttgttttcagagcttccctggtgattgtgataagcctggtttggaaaccattgctggagaactttgtaaagatacagagacccagaccttttgtatttacatttaaatacaaatacaaatcctgggtttctatatattctgttagcttttcaggtgattctgctacacagacgttgaaaaccactgccctaagaaagagatcagaggccacatatcagagagaaaagggaccaaaccttcggtggtttgttgtgtgtcgttttaatgccaattattttaacttgcacagtcttctgaaaccttgtattaatagttctcttttgtattaccattttcaggtagggttttgatcactatgattctgaagataatagtgaaatagtgaatttcattgatatgaagagataattgattttcattcattggtttgaacacctgcaaaatcacaaataaatgagaactaagtcttgta

SEQ ID NO: 173123 - DNA, 1441 bp, Homo sapiens
  Payload ID: 14027
  Gene Symbol: RAB29
  Gene Name: RAB29, member RAS oncogene family
  Uniprot ID: O14966
  ENST ID: ENST00000446390
  CDS Start-End: 278-817
agtcaggccaggagggggtggggaaggtgcgaacagccgggggctcggagctcgcgccctgcgccccacccaggttgcggccgcccggggaggaagcgcgtataggttgagtgcaaagtttccttttttgctttctcgtcagagcagcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgacaattttattaagtacatttgaattgtctcctgactactgtccagtaaggaggcccattgtcacttagaaaagacacctggaacccatgtgcatttctgcatctcctggattagcctttcacatgttgctggctcacattagtgccagttagtgccttcggtgtaagatcttctcatcagccctcaatttgtgatccggaattttatgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggagggggtctgggcatctgtggatttttggctactagaagtgtcccagaagtcactgtatttttgaaacttctaacgtcataattaagtttctcttgtcttggcatcaagaatagtcaagttttttggccgggcatg

SEQ ID NO: 173124 - DNA, 1157 bp, Homo sapiens
  Payload ID: 14027
  Gene Symbol: RAB29
  Gene Name: RAB29, member RAS oncogene family
  Uniprot ID: O14966
  ENST ID: ENST00000414729
  CDS Start-End: 504-1115
tgacgcttgcggaggaaggggagagagaggcgcgcgggagggcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccggtgggtgaggttccgcggcgcctggtccagtttctcggcagtcaggccaggagggggtggggaaggtgcgaacagccgggggctcggagctcgcgccctgcgccccacccaggttgcggccgcccggggaggaagcgcgtataggttgagtgcaaagtttccttttttgctttctcgtcagagcagcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttt

SEQ ID NO: 173125 - DNA, 1306 bp, Homo sapiens
  Payload ID: 14027
  Gene Symbol: RAB29
  Gene Name: RAB29, member RAS oncogene family
  Uniprot ID: O14966
  ENST ID: ENST00000437324
  CDS Start-End: 272-667
gcggaggaaggggagagagaggcgcgcgggagggcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccgtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgacaattttattaagtacatttgaattgtctcctgactactgtccagtaaggaggcccattgtcacttagaaaagacacctggaacccatgtgcatttctgcatctcctggattagcctttcacatgttgctggctcacattagtgccagttagtgccttcggtgtaagatcttctcatcagccctcaatttgtgatccggaattttatgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggagggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgt

SEQ ID NO: 173126 - DNA, 1571 bp, Homo sapiens
  Payload ID: 14027
  Gene Symbol: RAB29
  Gene Name: RAB29, member RAS oncogene family
  ENST ID: ENST00000528078
  CDS Start-End: 319-447
gtgacgcttgcggaggaaggggagagagaggcgcgcgggagggcgtctagggaatcgaggtgccggctgctccttcctcacaatttggtttgtgctgcaaggggagggtccccatcatctggccccagtggtgtaaggagctgactgggattcagtcactgacttggagccgctcgggggaagtcccgcccagacaggcggtgggtgggaatgcctcacttcagtttgaagagggtccggatccaaaggggttaaaacgagcgacccccgatccccgaccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgacaattttattaagtacatttgaattgtctcctgactactgtccagtaaggaggcccattgtcacttagaaaagacacctggaacccatgtgcatttctgcatctcctggattagcctttcacatgttgctggctcacattagtgccagttagtgccttcggtgtaagatcttctcatcagccctcaatttgtgatccggaattttatgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggagggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctc

SEQ ID NO: 173127 - DNA, 3848 bp, Homo sapiens
  Payload ID: 14028
  Gene Symbol: RAB2A
  Gene Name: RAB2A, member RAS oncogene family
  Uniprot ID: P61019
  ENST ID: ENST00000262646
  CDS Start-End: 352-990
tggcggggcgcggccagcgtgcagggctgggccagcgtgcggggctcctcccctttcctccggcggcgccggcggccgcagaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttctaggtcaattgatgtgattatttttgttaaatgttgtcttgtgcccttaactacgaactgaattgtattaaacactacaaagtcatcttgagtattttaaatcggtttgtgtagttaggtttcccaacatctgtggttacctaatgtttaatattatagaactgtcctcagaaactttgtcaattttcacggctataaggaaacagaaggactcttttaattctgtatttatcatttactttctgtatatatagtttaataacctgcttgggtgtaatttgccaagcttgaattctttaatgcatttgcataaattctatactgtttagagcttaaagctacagaagcattgttaggaattgcttggacactgaattttaaactttttgacattgttaacaagcatgttcatcttttcttgtcactagtccaagaaaaatatgcttaatgtatattacaaaggctttgtatatgttaacctgttttaatgccaaaagtttgctttgtccacaatttccttaagacctcttcagaaagggatttgtttgccttaatgaatactgttgggaaaaaacacagtataatgagtgaaaagggcagaagcaagaaatttctacatcttagcgactccaagaagaatgagtatccacatttagatggcacattatgaggactttaatctttccttaaacacaataatgttttcttttttcttttattcacatgatttctaagtatatttttcatgcaggacagtttttcaaccttgatgtacagtgactgtgtaaaatttttctttcagtggcaacctctataatctttaaaatatggtgagcatcttgtctgttttgaaggggatatgacaataaatctatcagatggaaaatcctgttacaaagtagaaaagctttagtaatttactcagtgtggtggttttatcctttttttctttttctcccttggtctataatgaaattgttacagcagtgcaaaataaaatcctatgtataaaagtgttctttttttttattatgaccacctcttttttaatgtatttttagtccacttacagcttttacatgggtttaagcatgttttttaaaagggtcagaatggttaacactcaaccctttttaaaaattttgctaaaatgcgacaaatctcaccatactgaaattatttttgttgatggtgtaagcagtgtaagcaagtgttttctcctgaactagcacaaaagcacttatgcctgaaagaaagcataaagaagttctaactctgaaactaactactttcatttcgctcatggccttcaactttctacaggtcttccctgaagattcagcagtactctctcaaaggtttgacagtactcttgtgggaaatcaccaaatgctgtcatagttttgttttaactgtctccttgagggcagagggaagggtgagagaaaatctgttttcatgggtatttgtagtacagcctttttttctttcaagtggctgtatcaaattcactggtcttactaatcactgtctttaccagtgagtacaaaaagttaaggcaactaggacaggtactgctctataccaagaagagaatgattctttggaaattgttatttttaagcttctgttaatttttccagaagtttagtgcgtttcttttccatactttctcccctaattcttttatttgaagaagagaacttaatggcaaataaacaacaaaccaggacatgcattttaataccctaaggaaaaatggaaccctcaaatataactcctcccacaaccaccctaatgtgcctcagtctggggcagcaggtggacttctcaatagttcttttccacattctctacaaatcacatctaccgttaaggaatatgttatgaatcctttctgttaattgagaaagcaatgttattgtctgtgatttccagtctttgctcattttattatccctgtcaaataatgtaatattggtacctgcagttgaatttgtaatattgtaattgaatttttagttgatcttcgatcagtttttatagcatctatggacatagaaaatcagtcactgaaaaaaataaacacagctttcaatgtctcactcaacatgtaacattcaaaattgtgatcttcataaagacattgttaccattcgtcttgcaaatttaagacaactgaatgaaaagccaattttttgaaagaatgtggcatataattagatatacaactgaaacaggatatacaactgcatacaatttgtttttaatgatattttaaaatagcctgttagcaggaaaatagtccctatttatctgctaatggtcaaaaagagttaggatataaatcgtaccaaaatgtttccaatcactcagaaaaactgattcatgtctggctttgcaacaccttaaacatttattctgtcatagatagtaaagccccatctcagtttatttagtcctgaggttggcagcatggggtttgactatatgagctaaaagatacacaaagagataacgctgtttcataataaacaggaattgactatacaaataggtaaaccagcatatctacctgtatttctcagagtttagatgtgtgctttatgtttacattaaaataaagcctaacgccacagta

SEQ ID NO: 173128 - DNA, 737 bp, Homo sapiens
  Payload ID: 14028
  Gene Symbol: RAB2A
  Gene Name: RAB2A, member RAS oncogene family
  ENST ID: ENST00000452437
  CDS Start-End: 1-313
gagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggtatatacatataaatattgttggtcaatattaatttagagttcacttttgattactattttatattttttattttataattcattattttataatttttttaattcctaaaatcaatcatgataatcagttaacaccattagtttacagtcatccaactgaaaaattggtatatgtggtatagtagttaaatatttatgttctagtagagcaacactttgtctatggaaatggattaaagtaagtggccctatccattcattgcaagcaatgcaaaataatataaatcccccaaagagaaaagaaaatccacttttatccacatgaccatatggtgtcatctgctttgggaataatgttctggtatataaatgcatgtactatgtactaatgcaagatgctctctctgttatctggcaggaaagagggaaataccaaatttggaaattactcccaatatagc

SEQ ID NO: 173129 - DNA, 680 bp, Homo sapiens
  Payload ID: 14028
  Gene Symbol: RAB2A
  Gene Name: RAB2A, member RAS oncogene family
  ENST ID: ENST00000529579
  CDS Start-End: 28-573
gtgccctggcactgagcggccgcggccatggcgtacgcctatctcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgt

SEQ ID NO: 173130 - DNA, 1058 bp, Homo sapiens
  Payload ID: 14028
  Gene Symbol: RAB2A
  Gene Name: RAB2A, member RAS oncogene family
  Uniprot ID: P61019
  ENST ID: ENST00000531289
  CDS Start-End: 273-839
agaacttccgggtcggcgcggaggcggggcggaggcgccgcggcggctgttattgttcggctgggctcggtcgggcgctgtctccctcggctctgcgggtgtcagttcgtccggcttcctcacagcccctcactcccggcggctgacagcagcagcggcggcggcgggcggcgcctggcgtttcgaggctgagcggcaccggggttggggcgcggaggaggagcagcagcgggaggaggagccgtgtgccctggcactgagcggccgcggccatggcgtacgcctatctcttcaagtacatcataatcggcgacacaggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagattttggagattgtattcatatctatttgcatttgatttcta

SEQ ID NO: 173131 - DNA, 566 bp, Homo sapiens
  Payload ID: 14028
  Gene Symbol: RAB2A
  Gene Name: RAB2A, member RAS oncogene family
  ENST ID: ENST00000531098
  CDS Start-End: 537-566
gcttttcccagaaaagtagatctcagacacttattgctggcttatttgtttgttcataggggagtatgataaaatgaactattaactatgctttaaatattttcactgtaacacaaaaaacaaaagtgcacaaaaacagtactgtagtagaggctaccagaaggacctggttagttgtcatctgtgagtttagctgccatatttatctttcacattgaaatattaaatgtgtaagaaagggtgaaaatgtactttagattggtttacagcttccacctaaatcatcagtcctcttattttgcaagaaattagagtactgaggaaatcatggtagattattcacagtgcaccagaaaccctggctgcctcttttccatgtcctttttgtaaagcatcttaatttctgtgaattttgtctcttatttatttttttttaactttcaggtgttggtaaatcatgcttattgctacagtttacagacaagaggtttcagccagtgcatgaccttactattggtgtagagttcggtgctcgaatgataactattgatgggaaacagataaaa

SEQ ID NO: 173132 - DNA, 866 bp, Homo sapiens
  Payload ID: 14028
  Gene Symbol: RAB2A
  Gene Name: RAB2A, member RAS oncogene family
  ENST ID: ENST00000466595
  CDS Start-End: 1-407
tcttcaagtacatcataatcggcgacacaggtgttggtaaatcatgcttattgctacagtttacagacaagaggtttcagccagtgcatgaccttactattggtgtagagttcggtgctcgaatgataactattgatgggaaacagataaaacttcagatatgggatacggggaagtcaaagaagaaacatacgttgcccctggtttctgttcattggcagaaaaaaggcagaggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattggaaataaaagtgatttagaatctagaagagaagtaaaaaaagaagaaggtgaagcttttgcacgagaacatggactcatcttcatggaaacgtctgctaagactgcttccaatgtagaagaggcatttattaatacagcaaaagaaatttatgaaaaaattcaagaaggagtctttgacattaataatgaggcaaatggcattaaaattggccctcagcatgctgctaccaatgcaacacatgcaggcaatcagggaggacagcaggctgggggcggctgctgttgagtctgtttttactgtctagctgcccaacggggcctactcacttattctttcaccccctctcctcctgctcagctgagacatgaaactatttgaaatggctttatgtcacagaagactttaatccgtcaaattcttgtataactttgaataaatggttaatgttcacttaaaagacagat

SEQ ID NO: 173133 - DNA, 410 bp, Homo sapiens
  Payload ID: 14028
  Gene Symbol: RAB2A
  Gene Name: RAB2A, member RAS oncogene family
  ENST ID: ENST00000534260
  CDS Start-End: 1-209
gtgttggtaaatcatgcttattgctacagtttacagacaagaggtttcagccagtgcatgaccttactattggaacaaagcatcttggagcccaggaagcagaaactgttaagagctatcctgcagcaggagcagttgtgttagcttctcatctgctcggatggaatggtcacaggtgtagagttcggtgctcgaatgataactattgatgggaaacagataaaacttcagatatgggatacggcagggcaagaatcctttcgttccatcacaaggtcgtattacagaggtgcagcaggagctttactagtttacgatattacacggagagatacattcaaccacttgacaacctggttagaagatgcccgccagcattccaattccaacatggtcattatgcttattgg

SEQ ID NO: 173134 - DNA, 2928 bp, Homo sapiens
  Payload ID: 14029
  Gene Symbol: RAB2B
  Gene Name: RAB2B, member RAS oncogene family
  Uniprot ID: Q8WUD1
  ENST ID: ENST00000397762
  CDS Start-End: 102-752
aagggggagaagaagaagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgctgaacatctggcttgaactttttttgtccttcctggaatagcttcagatcaataggcttaatgaaagaggtctttcttgctttggctgagagcagcctctttttaaagtgtgatgttttgcctttccacctaaagaccaggagagaatttgggcccttactgacctgtcctccttcagggacatgagcattccctatagattagggttcttcttatcctcctatacaaatttcttaaattgttaggatcaaagttgattatcacagtagttaaaaaataatttcatggcggggcgccatggctcatgcctgtaatcctagcactttgggaggccaaggtgggcagatcacctgaggtcaagagttcgagaccagcctgaccaacttggagaaatgccatctcaactgaaaatacaaaattagctgggtgtggtggtgcatgcctgtaatcccaggtactcgggaggccaaggcaggagaatcgcttgaacccaggaggtgaaggttacgctaagccaagatcacgccattgcactgcagcctgggcaacaagagcaaaactctgtctcaaataaataaataattttttttttctttttttttttttttttttggggggatggagtctcactctgtctccaggctggagtgcagtggcatgatcttggctcactgcaacctccactttccaggttcaagcagttctcctgcctcaacctcccgagtagctgggactacaggcatgtgccaccacacctggctcatttttgtatttttagtagagacagggtttcaccatgttggccaggatggtcttgatctcttgacctcgtgatccgcccaccttggcctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccgttctcttccacagccctgaggtcttacgaatttttctactttctttttgctgttgatgaattgtttcattattaaatatatgcatgtatcaaagcta

SEQ ID NO: 173135 - DNA, 559 bp, Homo sapiens
  Payload ID: 14029
  Gene Symbol: RAB2B
  Gene Name: RAB2B, member RAS oncogene family
  ENST ID: ENST00000417141
  CDS Start-End: 87-275
aagatcggtagattgagtggctagagaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacgtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccagcggaactctcgtgacatagggtccaactctggctgctgct

SEQ ID NO: 173136 - DNA, 1987 bp, Homo sapiens
  Payload ID: 14029
  Gene Symbol: RAB2B
  Gene Name: RAB2B, member RAS oncogene family
  ENST ID: ENST00000622293
  CDS Start-End: 63-692
agaggtcggaggtaagtggctatagaagtcgggcggacccggaacccagaggacgcgacaccatgacttatgcttatctcttcaagtatatcatcatcggagacacaggtgtggggaagtcatgtctcctcctgcagtttacagataagcggttccagcctgtccacgacctcacaataggtgtggagtttggagctcgtatggtcaacattgatggaaaacaaatcaaactgcaaatctgggatacggctgggcaagaatccttccgttctatcacccgttcctactacaggggagcagctggagcactgctggtgtacgacattacaaggcgtgaaaccttcaaccacctgacctcatggttagaggatgcccggcagcactctagttccaacatggttatcatgctcattgggaataagagtgacctagagtcccgcagggatgtgaagagagaagaaggagaggcctttgctagggagcatggacttatattcatggaaacttcagccaaaacagcctgcaatgttgaagaggccttcattaacacagccaaagaaatatataggaagatccagcagggtttatttgatgtccacaatgaggcaaatggcatcaagattgggccccaacagtcaatttcaacatcagtgggacccagtgcctcccaaagtgctggattacaggtgtgagccaccgtgcctggcctaaataaataatttcgtaagcatatacaatccacttcccactaagaattagggtcaaagacattctatttgaacacttgcaattacctagatctagttggcctttggttgatagatcctctgcctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccgttctcttccacagccctgaggtcttacgaatttttctactttctttttgctgttgatgaattgtttcattattaaatatatgcatgtatc

SEQ ID NO: 173137 - DNA, 4914 bp, Homo sapiens
  Payload ID: 14030
  Gene Symbol: RAB3GAP1
  Gene Name: RAB3 GTPase activating protein subunit 1 (catalytic)
  Uniprot ID: Q15042
  ENST ID: ENST00000264158
  CDS Start-End: 44-2989
cttcttcccggcagccttagcgccaggcccggcgctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactctttgatgatacacgggaagcagaaaaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaaatacatatctatatataatatgtgtgtgtgtgtgacatatgcacacgtctctgtgtatgtgaagtaggggaggccctgggggatgacctcccagcctttatgatgcttttctctatgctgctggacttcattcttactggtccacgcagatgcaggcggcctgaggccagtgctgtaccaagtagaagacggttcctaaggacagagtttgtctgttttctaacaaagaaaaattctacaaaggagaggttgggcgttacaaaggcattgtgaatctaataaaaggaaagtgtcgctttctgtggcgttttctttcattttctcccgctgaggcatttcagtctaatttcatgtggttttgtgctgtctcagctctaatgtttgcagcctgctgagcctaacaaggcagtggtctcaagaacattctttgtgcctttttaaagtactccattttatttttatgatagttatgtatttatttcacagatatatttaagtacccactttgtgtcaggtacagtacaagcaatgaagataaaacagaaaccaaaacacactcccttacagggaaaactgacaccacgttgccacaaaatgttgagtatagtcaactctgctgtgtggatcggagggcctgcatttatcctacaaataattgaatgtaatcctacattcatgtattcattggcagtacggagtaataaatgcagcaatgtca

SEQ ID NO: 173138 - DNA, 1139 bp, Homo sapiens
  Payload ID: 14030
  Gene Symbol: RAB3GAP1
  Gene Name: RAB3 GTPase activating protein subunit 1 (catalytic)
  ENST ID: ENST00000425393
  CDS Start-End: 10-186
ctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaaggtcagatctatttgctggtgtctctaaatgactatttactttgaaacctctattttccagccctttgctgcatttggcacatttgaattaaatgttttttaaagttacgtataatctataaacatcaaatagcatttggaagaatttggatttaaatctgtggcaaatgatatatgtaagacatttgtgaaatgtttaataaagttatatatatgtgtgtgtgtatatatatatatataaaatgtcattctttgtgagtgattctttgtgagtgaagtttgcttctcttttgccttctcccttggaatgttaaaacatgtttttaaaagttttttatttggtcagagaaacattgcagtgaccatcttctttggtagcatattttgcttactaatgaggaaaattctagtacttaccattgacttactgtagttaacaactatttcactcagtttttgtattttataatatcactaataacatcccccttcccttttaagctttttaacttatggatgttttaaggattttatttaagaatgaaaaaattactctttgaaattgaggtagaaatcaaattctaatctaaagtattggtagttttattcataaaccacaccccaaatgtttactgaagaatgtactctgagaacaaacctggattcactgtgaagggatctaacaatttgattttaagtttatgtagatgcttagtttgttagataaattcttttgaaataaaatttatggttggttttattacaactcaatattactaactcagtgataacttattaactcagtaattattaattcaatagtaatttaattataatttaccctgtgttaggaactttgagttctcaatatttgctaggggttttcagctttgtgatggtgatactatcaaaaaagagactgtcaaaatgcattaggaagccaggcaacatggtgagaccctgtctcttaaggaaaaaaaa

SEQ ID NO: 173139 - DNA, 4185 bp, Homo sapiens
  Payload ID: 14030
  Gene Symbol: RAB3GAP1
  Gene Name: RAB3 GTPase activating protein subunit 1 (catalytic)
  Uniprot ID: Q15042
  ENST ID: ENST00000442034
  CDS Start-End: 11-2977
gctcctcaagatggctgccgacagtgagcccgaatccgaggtatttgagatcacggacttcaccactgcctcggaatgggaaaggtttatttccaaagttgaagaagtcttgaatgactggaaactgattggaaactctttgggaaagccactcgaaaagggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactctttgatgatacacgggaagcagaaaaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagaggctgactgaatcttctgatgaggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcaggtgccttttcatcagatacttccttcttctgattcttctagcattactcgttggtggcttcagagacagtgctgcctcctcctgagggagggaaggtaccagggagaacctgggaggtcctggagagggccctgtccagttgggtgatcaggaatcaaaccagcatcggaaagacttcccagcaccaagcttgagctgtgtcgtttcgtggagggggcagcgaggatgggcttgagctgttgagagatttctgccctagagatggcctttgtatatgggggggtggtggggggacacaaacacatcagacactccgtcctcacactggcaggacggtgttcatcgcattctcttctgtgaccagcctctaggctagcggctgcattcgtggtctgtgcaaacacttcgtggttctatatatcagcagcaagtgtgcaaaataaaggacctgttaactcagatttctggatattttggtggtagcttctagtcccagaatctgtgtttttaaaatactacatgacattctgtctattcaatcacctggtggtcatctttcttgtactaattaactgttgatgagcattttggatattctaggagaaagcctataatttcacatagtttctctttttcatgtaactgtaacctaaatgtattacttctgataaaactatatatcaaatgtcactgcaaattagttttatatctgtcatgtgagatttgtcttacttatttttcttttggttgccatggaagttatggccctgaaaatcgtctccctccccttctcttgctgtacagcatgcgttctctttttgtggttgctggctgggtactgtatttaatgaagtagagaatagcacttgcaaaaatacagtcttggtacctagagactgtcatgcagatagtataatttggtatatgtgctaatgcattgagtagaggattattttaacacactattttgcttttgtattttagttaaaataatcgatggggatgtgtagcccccccgtgtgaggatgacatcaccacatttctagtttcatggagctcaagatgtcttgtgtctgtgtggctagatggcctctgcttggtaatcttatttttaggcctaaaattcccacttaaatccaaagtaaaaatggttatactgaagcataaaccttgcctgtgtaattttaaaaaattaatagagctgtgcaaaccctgttatttttgtaaaaaaaaaaaaaaa

SEQ ID NO: 173140 - DNA, 3161 bp, Homo sapiens
  Payload ID: 14030
  Gene Symbol: RAB3GAP1
  Gene Name: RAB3 GTPase activating protein subunit 1 (catalytic)
  Uniprot ID: Q15042
  ENST ID: ENST00000539493
  CDS Start-End: 1-2808
atgttctcactcataagtggtatatttacttctggcacatgggaagagaaatcagatgaaatttcctttgctgacttcaagttctcagtcactcatcattatcttgtacaagagtccactgataaagaaggaaaggatgagttattagaggatgttgttccacaatctatgcaagatttgctgggtatgaataatgactttcctccaagagcacattgcctggtaagatggtatgggctacgtgagttcgtggtgattgcccctgctgcacacagtgacgctgttctcagcgaatctaagtgcaaccttcttctgagttctgtttctattgccttgggaaacactggctgtcaggtgccactctttgtgcaaattcaccacaaatggcgaagaatgtatgtaggagaatgtcaaggtcctggtgtacgaactgatttcgaaatggttcatcttagaaaagtgccaaatcagtacactcacttatcaggtctgctggatatcttcaaatcaaagattggatgtcctttaactccattgcctccagttagtattgctattcgatttacctatgtacttcaagattggcagcagtatttttggcctcagcaacctccagacatagatgcccttgtaggaggagaagttggaggcttggagtttggcaagttaccatttggtgcctgcgaagatcctattagtgaactccatttagctactacatggcctcatctgaccgaagggatcattgtggataatgatgtttattctgatttggatcctattcaagctccacattggtctgttagagttcgaaaagctgagaatcctcagtgtttgctaggtgattttgtcactgaattttttaaaatttgccgtcgaaaggagtcaactgatgagattcttggacgatctgcatttgaggaagaaggcaaagaaactgctgatataactcatgctttgtcaaaattgacagagccggcatcagttccaattcataaattatcagtttcaaatatggtacacactgcaaagaagaaaatccgaaaacacagaggtgtagaggagtcaccgctaaataatgatgttcttaatactattctcctgttcttattccctgatgctgtttctgagaaaccattagatggaactacttcaacagataataataatcctccatcagagagtgaagactataatctctacaatcagttcaagtctgcaccatctgacagtttaacatacaaactggctttgtgtctctgtatgatcaatttttaccatggagggttgaaaggagtggcacacctctggcaggaatttgttcttgaaatgcgtttccgatgggaaaacaactttctgattccaggattagcaagtggacccccagatctgaggtgttgtttactgcatcagaaactacagatgttaaattgttgtattgaaagaaagaaggcacgtgatgaggggaaaaagacaagtgcttcagatgtcactaatatatatccaggggatgctggaaaagcaggagaccagttggtgccagataatctaaaagaaacagataaggaaaagggagaggtaggaaaatcttgggattcctggagtgacagcgaagaagaattttttgaatgcctaagtgatactgaagaacttaaaggaaatggacaagagagtggcaagaaaggaggacctaaggagatggcaaatttaaggccggaaggacggctctatcagcatgggaaacttacactgctgcataatggagaacctctctacattccagtaacccaggaaccagcacctatgacagaagatctgctagaagagcagtctgaagttttagctaaattaggtacatcggcagagggggctcaccttcgagcacgcatgcagagtgcctgtctgctctcagatatggagtcttttaaggcagctaatccaggttgctccctggaagattttgtgaggtggtattcaccccgggattatattgaagaggaggtgattgatgaaaagggcaatgtggtgctgaaaggagaactgagtgcccggatgaagattccaagcaatatgtgggtagaagcctgggaaacagctaagccaattcctgctagaaggcaaaggagactctttgatgatacacgggaagcagaaaaggtgctgcactatctggcaatccagaaacctgcagaccttgctcggcacctgttaccttgtgtgattcatgcagctgtactcaaggtaaaggaagaagaaagtctcgaaaacatttcttcagttaagaagatcataaagcagataatatcccattccagtaaagttttgcacttccccaatccagaagacaagaaattggaagaaatcattcaccagattactaatgtggaagctctcattgccagagctcggtcactaaaagccaagtttggaactgagaaatgtgaacaggaggaggaaaaggaagatcttgaaaggtttgtgagttgcctgctggagcagcctgaagtgttagtcaccggtgcaggaagaggacatgctggcaggatcattcacaagctgtttgtgaatgcccagagggctgcagctatgactccaccagaggaggaattgaagagaatgggctccccagaggaaagaaggcagaactccgtgtcagacttcccaccccctgctggccgggaattcattttgcgcaccactgtgccgcgccctgctccctactccaaagctctgcctcagcggatgtacagtgttctcaccaaagaggactttagacttgcagttaaaataatcgatggggatgtgtagcccccccgtgtgaggatgacatcaccacatttctagtttcatggagctcaagatgtcttgtgtctgtgtggctagatggcctctgcttgctccccaggtgtgtcctggtagacaactgctcccaggagctggcatagaagcaaacctgcaggaaaagccaacccactccaggtgtgtggaagctgctggcaggaacccagcaaggatccagctgggttgtaatggaaacaatgcaaccaacaatccttgagcgagccgggatagatgtggcctcatcactgaagatttcatctgagacctctgcaaatatccaaattgtatatgctcttagagcagatcattttctcacaggt

SEQ ID NO: 173141 - DNA, 7257 bp, Homo sapiens
  Payload ID: 14031
  Gene Symbol: RAB3GAP2
  Gene Name: RAB3 GTPase activating protein subunit 2 (non-catalytic)
  Uniprot ID: Q9H2M9
  ENST ID: ENST00000358951
  CDS Start-End: 118-4299
ggtttctccgccttctgcttggctagagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctgaagaagaaggaaatacttgcaaaacacaaaaaacttcctggctccaagattgtgttttatccttatctccaaccaatgatcttatggtgatagctcgagagcaaaaagctgtatttctagtgccaaaatggaaatatagtgataaaggaaaggaagaaatgcaatttgctgttggctggagtggttccttaaatgtcgaagaaggggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaagctgcagcatcaggcaatgagaacatacaaccaccaccattagcttataagaaatggggtctacaagatattgacactattattgatcatgctagtgttggtattatgactctgtccccctttgatcaaatgaagactgcctccaatataggtggatttaatgcagcaattaaaaatagtccacctgccatgtctcagtatatcactgtagggtccaatccatttactggcttcttctatgctttagagggaagcacacaaccattattatcccatgttgcactagcagttgcaagtaaactcacttctgctttatttaatgctgccagtggttggcttggttggaaaagtaagcacgaagaagaagctgtccaaaagcaaaagccgaaggttgagccagctaccccattagctgtaagatttggacttccagattctagacgccatggtgaaagcatatgtctgtctccatgtaacacactggcagcagtaacagatgatttcggcagagttattttattggatgtagctagaggaattgcaatacgcatgtggaaagggtaccgcgacgcacaaattggatggattcaaactgtagaggacctccatgaaagagtgccagaaaaggcagatttttccccctttggaaattctcagggtccaagtcgagtagctcaattccttgtgatctatgcgccaagaaggggaattttagaagtgtggagcacacagcagggacctagagtaggagctttcaatgtggggaagcactgcaggctgctgtatcctggctataaaataatgggtttaaataatgttaccagtcagagttggcagccacagacttatcagatctgtctggttgatccagtgtctggaagtgtgaaaacagtgaacgttcccttccatttagcactgagtgataagaagagtgaacgagccaaggatatgcacctagtgaagaaactagcagccttactgaaaacaaaatctcccaatcttgatttggttgaaacagaaataaaggaattaattcttgatattaaataccctgcaaccaaaaaacaagctttggaaagcattttggcaagtgaacgtttaccattttcttgccttagaaacatcactcagactttaatggacactttaaaaagtcaagaacttgagtctgttgatgaaggattgctacagttttgtgccaataaactaaaactgctgcaactctatgagtctgtcagtcaattaaattcccttgattttcatttagacacaccattctctgataatgacttggctctgttactaaggcttgatgaaaaagaactgcttaagctccaggcattactagagaaatataagcaagagaacaccaggacaaatgttcgattttctgatgataaagatggtgtgttgcctgtaaaaacattcttggaatatttagaatatgaaaaggatgtgctcaacataaagaaaataagtgaagaggaatatgtggctttaggtagtttctttttttggaagtgtttgcatggagaaagctccactgaggatatgtgtcacactttggagtcggctggtcttagccctcagctgttgttgtctctgctcctgagtgtttggctttcaaaggaaaaggatattttggataaaccacagtcaatctgctgtcttcataccatgctgtccctcctgagcaagatgaaagtggccatcgatgagacctgggattctcagtctgtgtccccatggtggcagcagatgcgcacagcctgtattcagtctgagaacaatggagccgctctgttgtctgcgcatgttgggcattctgttgctgcacagatatcaaacaacatgacagagaaaaaattttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtggcattgcagacagtgtagccaagtggatatttaaacaggacttcagccctgaagtattaaaactggctaatgaagaaagagatgcagaaaacccagatgaacccaaagaaggtgttaacagaagtttccttgaggtatcagagatggagatggacttaggagccataccagacttactgcatttagcctatgagcagtttccttgtagccttgagctcgatgtcttgcatgcacattgctgctgggagtacgttgttcagtggaataaagatccagaggaagcacgtttttttgttaggtcaatagaacacttgaagcaaatatttaatgcacatgttcaaaatggcattgcactgatgatgtggaatacgttcttagttaaaagattttctgctgctacatacttaatggataaggttggaaaatcaccaaaagataggttatgccgaagggatgtgggaatgagtgacacagcaatgacatctttcctcggctcctgtttggatcttcttcagatcttaatggaggcagatgttagcagggatgaaatacaggtgcctgtgctggatactgaggatgcgtggctctccgtggaaggaccaatctccatagtggaactggcccttgaacagaagcacatccactacccactggtggagcaccactccatcctgtgctccatcttgtatgcagtcatgaggttttctctgaagaccgtgaagccactttcactttttgacagtaagggaaaaaatgcatttttcaaagacctaacttcaattcagttattacctagtggggaaatggatccaaattttatttctgtacgacaacagttcttattgaaagttgtcagtgcagctgtccaggcccaacattcagccacaaaggtcaaagatcccacagaagaggccacacccactccttttgggaaagaccaagattggccagctctagctgtggatttagcccatcaccttcaagttagtgaagatgttgttagaaggcattatgtgggggaactatacaactatggagttgaccacttaggagaagaggccattctacaggttcatgacaaagaggtccttgcctctcagctgctggtgctcacggggcaaaggctggctcatgcgcttctccacacccagacaaaagaaggaatggagctgcttgccagacttccacccacactgtgtacttggctgaaagcaatggacccccaggaccttcaaaacactgaagtgccaattgcaacaacagctaaactagtaaataaagtaattgagcttttaccagaaaaacatgggcaatatggtctagccttacacctcattgaagctgtggaagccatatctcttccttctttatgacacttacctactggaaatagtctaaaattatgattataacatgaagtagtgcatggttattttacatagtaagacctggaattttatgggaaaagtatgtctttttttttccttttgtaaaataaataaaagtatatacaacttttaaaaagtgcaaccctggctaaattccactcctttggttaatactgaagataaaatataaacaaatgtcaactctgttataattaatacagatgttttactgtttatttctaattcaaacacttaagtagctttattgttaaactttgctatttaaaattggttataatttagattatgttcttataagattctatatttcctatctaaaatgttgttgtaattcaatttaaatgtgttcatgtacagtccccatcagtagcgtatagaacaccccactctcctttagtaaatgttgagaaaatgcctttgttgtcatgctccaaatcccacactgggctgccacctgggagttctggataccgaaaggttcctttcccagaggttctgctgttgccatcagaggaggatgaccgtgcttgaggaggaagaatgggttcaagatcatcatattcatcagaaggggacactaaatagaacccttaacctgttgtacttgccaaaattgagaatcagagatgtgtaaaatgcagcaaattaattataatgtaagttaagatttgctttttgccaagttgcaaagttgtatccacatcaggtcactgtaaaaatgtattatcttgtaaaacttatgtaaaaaaaaaaaaaaaaaaaaggcaaagatactaaaaattttaagtccgactttatttttcctacaagtgtttagaaatgcttctgggatttgctaatattatctgtccttgggaacagtattgaaaaaactgcttagtggtattacagctttagcaaacctacctcacagctgggatgagaggataaaatacaactaattttgtaccctatagtgcctagagcagtccaagtgctaaataaatatttactgattaaaaccaaactatagctactcgggaggctggaggaggatcgcttgagcccaggagtttgaggccattctgggcaatatagcaagaccctgtctcgaaaaaaaaaaaaaaaagaaaaaaccaaactaaccaaaactctgtaaaagagtgctttgagctctacaaataccaagtatttattgtggtatatttttagaatgtagccatacagtgtaattatgggtatctgtcatggatcacaattattattcatagtaagtcattgtgatacagaagtttgtttcttcacttccccttaagaagccaactatagtaatcatgcaaagttgaggagtatgtccttcagggatataaaaagaaaaacaaatctgttttttgagctaaaagagcacatccaaacaagaatttaactggctaaaatttagtaattactgttaagtaactatcaaacttgaaatcttacaagataaatggttaagatgtcttgagtatttgggatgggggcctgtgagtctgattgagacatacattttacagagtagcagcactggaaagggctagtccaacctcccagcctctgcttgggtctccgctgccccagccacacacatcctagaattcttgtaaacatatctggctctgtgttaacagtcacttgttatatgttttctaagagattagttcttcctgtgatttttccaagtacgctgaaagtagtagtatgaacttaaggaggctagtcaaagaaacttggagttataggtatttttaaagaataaatcctcaattccatcatcacttggcggggagggggcacttattaagcattttagataataaaactggttaagcttactctggtagaacagacaatcaaatctggggattgctgagaacaataataagctgaagtatggctcacagaatcctaacacaaatcattaagtctctagttagatttgttatcctaaaatttttcatagaattttaaaatctaattctgacttgtatggttaagaaaagcagttaaatattttactacttatcaagggcttttaaaataaataaatctgattgataggaagaaaggcaaataaatacctatgtagacattctataataacaaagagccatagatgataaaggaattagattttaatgtagaatgggtggtttctgaaacaaaggtatgtggtactttgtagttattgatgagaagccagtaaccagtagtgttttcctagatatatgcccaccctcacacaactttcttcattaacaaacattaaatatgcatttgtatcttattaaattatattgtataatgctgaaggaaaacaaaaagtgttcaaataatcataacttctacattacaggttctgtttagatgcagaactagaggggccagggtaaatgtagataaagagatatatagcaccatgcttcttaatgcttcatacttttgcaaacagaaaaaaaaagttttacttttattataaaacttcatctatggtcaaagtaaacactgttacatttaaattgctttttaaaaacaattgcgatctaaaaagtcaaaaatctgaaatttaataatatgagacttacactgaatataatgttcatttagaagttgctgtggtccacttcatttataaggaacaaatatttttacagtacactatagcaacagcaaaagccctctctcaccctgataggaatgggtttgctgggtgtctagaagttagattcctgctgaatagaattagccatccttaaaagattttaatccaatactgaactgtttataaaatgctttctctattgtaatgtactgtaagtagtgaaattctgtatatactgctattttctgtctgttcattgttgtgaacttcttatgtatattagtgaaataaattttcagctttca

SEQ ID NO: 173142 - DNA, 515 bp, Homo sapiens
  Payload ID: 14031
  Gene Symbol: RAB3GAP2
  Gene Name: RAB3 GTPase activating protein subunit 2 (non-catalytic)
  ENST ID: ENST00000484658
  CDS Start-End: 1-515
agctgaagcagaggagagagagagagatagtaggaaatggctgcgtggggatcatttgagctttgctcagttgtgtatacagtcagttgtggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaagctgcagcatcaggcaatgagaacatacaaccaccaccattagcttataagaaatggggtctacaagatattgacactattattgatcatgctagtgttg

SEQ ID NO: 173143 - DNA, 539 bp, Homo sapiens
  Payload ID: 14031
  Gene Symbol: RAB3GAP2
  Gene Name: RAB3 GTPase activating protein subunit 2 (non-catalytic)
  ENST ID: ENST00000474178
  CDS Start-End: 34-282
aaggtgagtgccgtagtggggttccctggagccatggcctgctccattgtccagttctgctacttccaggacctccaggccgcccgggacttcctctttcctcacctgcgggaggagatcctcagcggcgccttgcggagggaccccagtaaatcaacagactgggaagatgatggttggggagcatgggaagaaaatgaaccacaagaacctggaatgtgtaaccagtgctctatgtatcccactagcaagccaaaagaggagttccactgggcgtcctgactggacctgcattgtggtgggttttacttcaggttatgtacgcttctacactgagaatggtgtgctcttgcttgcacagcttttgaatgaggacccagtacttcaacttaaatgcagaacctatgaaataccacgacatcccggcgtgactgagcagaatgaagagttgagtatcttatatccagctgccattgtgactattgatggatttagcctttttcaatctcttcgtgcttgtcgaaatcaggtagcaaaag

SEQ ID NO: 173144 - DNA, 1393 bp, Homo sapiens
  Payload ID: 14032
  Gene Symbol: RAB30
  Gene Name: RAB30, member RAS oncogene family
  Uniprot ID: Q15771
  ENST ID: ENST00000260056
  CDS Start-End: 407-1018
gtttcataatctgttggctcaaatctgctgctgccacaccctgtgcctctcagggtccctgggtcctgttgcagttatcatatgcctcacctttaacctaaatgactctgcgaagtggctgctatggaaggatttactgagtgcaaaatggattttcttccctgctctttggggcaaagctggctcagagattcttagctgcagggggaggggctggcaggcctgaaccgcagttggacttagcagccaggggttttctggttttcattaaaattctctggctgtcttttgggatagctccattggatatgactgtgcactggagccggttgtgctgttctctcagctgtacacacccatcaaatcacagtgcccctgaggacgagagaaaattgaagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgaggcacggagaagaaaaggaatcagcaactgccctgatgggccatgagatgctggggagatctggcgatgactgtggctcccgctctctgaccttctgactcctgtgggctcctgagcttacaaagcatggcaggccaagggcctcgaccacaggccagcattagcagaacatataatggtttcacccttttccagtctggagttggagcaaggagaaaattgcactaggcactccatgatctgcagagcatgttgcttttgtttttttaaaaagcaagtaaaagcgcattcctaaacagagtccggggggaaatgtactgtagggatccctcctgcacatcagtgggtgcatgtgggaactcttcttt

SEQ ID NO: 173145 - DNA, 580 bp, Homo sapiens
  Payload ID: 14032
  Gene Symbol: RAB30
  Gene Name: RAB30, member RAS oncogene family
  ENST ID: ENST00000534301
  CDS Start-End: 163-580
tttctgtctagctggcagggtcaccggaggggagctttaaattgctctttaaatgagtcagacctgttcccccggagagaaggctggtgcagcttgagctctgtgggcaagtctgactgggcctttctcacttttgcctgtgtttgccttgcagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaat

SEQ ID NO: 173146 - DNA, 591 bp, Homo sapiens
  Payload ID: 14032
  Gene Symbol: RAB30
  Gene Name: RAB30, member RAS oncogene family
  ENST ID: ENST00000526205
  CDS Start-End: 250-591
aagtgtagcagcagcaccagggcagggactgactccagcccttggactcaggacatcgcagaccttcccttgcgtgcgtgactcattcgcacatccatttctgtttatgcctggggtggggagaaaaatcccaaaccaggttggatggagtgcagtggcgcaatctcggctcacggcaacctccgcctcccgggttcaagcaattctcctgcctcagcctccggagtagctgggattacagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaag

SEQ ID NO: 173147 - DNA, 937 bp, Homo sapiens
  Payload ID: 14032
  Gene Symbol: RAB30
  Gene Name: RAB30, member RAS oncogene family
  ENST ID: ENST00000525117
  CDS Start-End: 98-382
gttcccccggagagaaggctggtgcagcttgagctctgtgggcaagtctgactgggcctttctcacttttgcctgtgtttgccttgcagctgtgtaaatgagtatggaagattatgatttcctgttcaaaattgttttaattggcaacgctggtgtggggaagacgtgcctcgtccgaagattcactcagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggtaagtaagggctaacgaggagggaaattgatttgtgggcattagaggatttataatcacataaagcttatacattggtgccttccaagaatatagtctttagctaataattcatgcagtcaaccttcagttcttctgcaattgaagagaaaatgaaataggtcctatcccatggtgacagtttagaaaaataaagtagaaaacattttctatcaatgtaggctctagggaagaagttggatggccatgaaagttatgtgagctgctaaaaatttaaaaagtctaattacaagatgaaaggaatggctgttctagaagaaaaatgtatcttttaagttgatatggaattcattattgaagcaattgtttattgcctaaaaggtggattttggtaattttttttcccttcctaacatttaggctgatttgagaaattctgtgtttcagaaagaatctgctaagggcaatgctgtagtttgtttcatcttgtaggagaataaaacctctatttagtatggggggaaagcacaaaacaacccttgattttctatcatgactgatat

SEQ ID NO: 173148 - DNA, 580 bp, Homo sapiens
  Payload ID: 14032
  Gene Symbol: RAB30
  Gene Name: RAB30, member RAS oncogene family
  ENST ID: ENST00000533014
  CDS Start-End: 1-504
tactgcagagacatccacaccaaatacagcagtgaatggggagctggagcactggaagataaaagcaggctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgaggcacggagaagaaaaggaatcagcaactgccctgatgggccatgagatgctggggagatctggcgatg

SEQ ID NO: 173149 - DNA, 558 bp, Homo sapiens
  Payload ID: 14032
  Gene Symbol: RAB30
  Gene Name: RAB30, member RAS oncogene family
  ENST ID: ENST00000528379
  CDS Start-End: 392-558
gaggttgctgcttgaggttgcatgggcctatggagcagggcctggggaaagaagctgtctgcttctatactcatgtgagtctctggatcatggtggtggccttctccttcactcatgtcgggacaactgagtccatggtgcatgggaaggtagagacatagctatcaccttccccagagccagtgatactgtgcctccactgaagattgctgggaggaattgaaagtttacagttcccatctcacagtgaggatgaaatgagatcagagcacctgatacatactccattggatatgactgtgcactggagccggttgtgctgttctctcagctgtacacacccatcaaatcacagtgcccctgaggacgagagaaaattgaagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtga

SEQ ID NO: 173150 - DNA, 548 bp, Homo sapiens
  Payload ID: 14032
  Gene Symbol: RAB30
  Gene Name: RAB30, member RAS oncogene family
  ENST ID: ENST00000533276
  CDS Start-End: 372-548
ttgtgctacggtctctccaccccctgctgctgctgggcttgcgattgccgctcgctccagctgagctaagtgtagcagcagcaccagggcagggactgactccagcccttggactcaggacatcgcagaccttcccttgcgtgcgtgactcattcgcacatccatttctgtttatgcctggggtggggagaaaaatcccaaaccagtttacagttcccatctcacagtgaggatgaaatgagatcagagcacctgatacatactccattggatatgactgtgcactggagccggttgtgctgttctctcagctgtacacacccatcaaatcacagtgcccctgaggacgagagaaaattgaagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaag

SEQ ID NO: 173151 - DNA, 588 bp, Homo sapiens
  Payload ID: 14032
  Gene Symbol: RAB30
  Gene Name: RAB30, member RAS oncogene family
  ENST ID: ENST00000531021
  CDS Start-End: 84-588
agtgcccctgaggacgagagaaaattgaaggtaggcaatagcctggctgagggctcttgctcagcaatctttgtgctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaattctcagaagctcaggacatgtattatctggagacctcagccaaggaatctgataatgtggagaaactcttccttgacttagcatgcc

SEQ ID NO: 173152 - DNA, 3746 bp, Homo sapiens
  Payload ID: 14032
  Gene Symbol: RAB30
  Gene Name: RAB30, member RAS oncogene family
  Uniprot ID: Q15771
  ENST ID: ENST00000534141
  CDS Start-End: 242-736
gtcattgcaaaagccccactgcattcattgtgctacggtctctccaccccctgctgctgctgggcttgcgattgccgctcgctccagctgagctaagtgtagcagcagcaccagggcagggactgactccagcccttggactcaggacatcgcagaccttcccttgcgtgcgtgactcattcgcacatccatttctgtttatgcctggggtggggagaaaaatcccaaaccagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgaggcacggagaagaaaaggaatcagcaactgccctgatgggccatgagatgctggggagatctggcgatgactgtggctcccgctctctgaccttctgactcctgtgggctcctgagcttacaaagcatggcaggccaagggcctcgaccacaggccagcattagcagaacatataatggtttcacccttttccagtctggagttggagcaaggagaaaattgcactaggcactccatgatctgcagagcatgttgcttttgtttttttaaaaagcaagtaaaagcgcattcctaaacagagtccggggggaaatgtactgtagggatccctcctgcacatcagtgggtgcatgtgggaactcttctttagggcttcggtggtaatcatctgggggccctggttttcttgtctaccagataaaccaaaactgggaaggccaagtacagtctctgtggtgcgtattgacgaccccatggagattttgaaaagtgttatttctcttgtccacaggcactttcaagaactttgggatgtaaaaatgaaatgaaacctttacccatgaccaacagtaacaatcattgttttaataatatatacaagctccataactccttttggtgctaatgattccgctatttcacagaccaaacgttttagtacattaatgtccttaaatgtgttatatagaaataaaaaaatgggggaagtccatgaatcagcactctttctcaaagtctcattactacctttttaaaggtggatttttgggaaaagagaatacttttccttttatgttcccctctgaatctctaccactttcttgtctctccagccctttatgtaaatgaaaacgtttgcaaaatgaaaaaaataaacaaatggttgatgacattctaatataaaaacttagctctaacacattttgagtagtatgaggaaacagaccagatatgaccaaaatactgtggattaatggactgtagtgcagggctcctagcagagcacagtccttgatagtaggtcacatcttttacttcctggtactctccatcttggacagaccaaggcttaggattttgtagattttttagtatgataagtgagaatagcaacagatgaaaagtctcacgacccatttttatatcttcgatgataaccttagaaaaattctgctcgtggaagcagattgaactgtcatttatcccctccttcttgtaataatgttaccttcagacgcttaaccatatgttctttcttttttctttctcttttcctctctatttttctggtctctccttttcttcttccctccctccctccctccttccctcccatccttatatgcctgtgttactgcaaatctccaattcaaatggaggtgtatatgcctttacttagccaatttaaaaacaggactcaaaatgggagatgtgctgctgaatatgtgtttctttttcttcagtgccatactttgatagcttccaatttgttcactgatataaatgcaaattgggaaaataattaaacctgtatgctgttgatgctgtcagatgtttctgtagcttgctgcttagcataactgagggatgagtaatggaataaggatatgatgtgtaattccactgttgctgtagatggtgacaatctcagttctgatatgttgatgtttgaaagctatttaattgtaaagaaattagtcatgtagagacatgatgtggataaagcatttctggcatttctctagcaggttctagattgaccagtgtcttgcacatgagattatgcatattttttaaggggctgatacttttggttggcctcactgtgtttttcctgatcctgtgggaaagagaaaggcatcccagaagtttgacttgtttttcttttagaatctgtctctgcaggaaagaaaagtcattttaataaaaaccaaaataatttataataattgttgcctttccctccccatcctctccactaagccagcaactaaatgtattcagaaaacaagttaatcaaggagggcagaagaattttttttaaactgtaagaaaatgttcctaagtttagatttattacctgtcatttagggcaaaaatccagtgtccccagcacatgatgacccaactttgtctcacagttgcaagtgtgttgaaaataaagttgctttgtgaacttagaggaaatggctgtgttagattggactgatttagttgcaaaataataccttttagggtcacacttgtattattccctagggtttagccttctctatatacccttggccagactcagaaggggattaaaaagctctggtcttggcctctatcttccttgttgctcctcccagcctttccataacttacccatccacagcccatcagcaggaacacatgagaatgtgggactttgtttctttttttcttagttgtatgaattccagattaggccttatggatacttgtctactaatatatctgaagtttgaaaacaatccctgacaatattgtaggtgcaataaatattagtcaaataaacatttaagtgccaaggtggggtggtagtggttgggggagctttttttgattaaacagaaattccttcaagtagaacttgagaaaggacactaaatacagtcatcttaacccaggccagaacctaaatttattggtttgcctaacagtcttattgtcatggcaatatttgctaagatgagccttctttagataaaaatgaactctcatttagtggtggatgaaaaaagagaaattgctttatcatatagtttaatttggctcggtctactaagaccaccagggttgatgtattcctccatttttggtgtgatctttttcttcattcaataaagttattaaatatatggcaaaa

SEQ ID NO: 173153 - DNA, 792 bp, Homo sapiens
  Payload ID: 14032
  Gene Symbol: RAB30
  Gene Name: RAB30, member RAS oncogene family
  Uniprot ID: Q15771
  ENST ID: ENST00000527633
  CDS Start-End: 173-784
gattgccgctcgctccagctgagctaagtgtagcagcagcaccagggcagggactgactccagcccttggactcaggacatcgcagaccttcccttgcgtgcgtgactcattcgcacatccatttctgtttatgcctggggtggggagaaaaatcccaaaccagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgag

SEQ ID NO: 173154 - DNA, 9929 bp, Homo sapiens
  Payload ID: 14032
  Gene Symbol: RAB30
  Gene Name: RAB30, member RAS oncogene family
  Uniprot ID: Q15771
  ENST ID: ENST00000533486
  CDS Start-End: 286-897
tgctgggcttgcgattgccgctcgctccagctgagctaagtgtagcagcagcaccagggcagggactgactccagcccttggactcaggacatcgcagaccttcccttgcgtgcgtgactcattcgcacatccatttctgtttatgcctggggtggggagaaaaatcccaaaccagctccattggatatgactgtgcactggagccggttgtgctgttctctcagctgtacacacccatcaaatcacagtgcccctgaggacgagagaaaattgaagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgaggcacggagaagaaaaggaatcagcaactgccctgatgggccatgagatgctggggagatctggcgatgactgtggctcccgctctctgaccttctgactcctgtgggctcctgagcttacaaagcatggcaggccaagggcctcgaccacaggccagcattagcagaacatataatggtttcacccttttccagtctggagttggagcaaggagaaaattgcactaggcactccatgatctgcagagcatgttgcttttgtttttttaaaaagcaagtaaaagcgcattcctaaacagagtccggggggaaatgtactgtagggatccctcctgcacatcagtgggtgcatgtgggaactcttctttagggcttcggtggtaatcatctgggggccctggttttcttgtctaccagataaaccaaaactgggaaggccaagtacagtctctgtggtgcgtattgacgaccccatggagattttgaaaagtgttatttctcttgtccacaggcactttcaagaactttgggatgtaaaaatgaaatgaaacctttacccatgaccaacagtaacaatcattgttttaataatatatacaagctccataactccttttggtgctaatgattccgctatttcacagaccaaacgttttagtacattaatgtccttaaatgtgttatatagaaataaaaaaatgggggaagtccatgaatcagcactctttctcaaagtctcattactacctttttaaaggtggatttttgggaaaagagaatacttttccttttatgttcccctctgaatctctaccactttcttgtctctccagccctttatgtaaatgaaaacgtttgcaaaatgaaaaaaataaacaaatggttgatgacattctaatataaaaacttagctctaacacattttgagtagtatgaggaaacagaccagatatgaccaaaatactgtggattaatggactgtagtgcagggctcctagcagagcacagtccttgatagtaggtcacatcttttacttcctggtactctccatcttggacagaccaaggcttaggattttgtagattttttagtatgataagtgagaatagcaacagatgaaaagtctcacgacccatttttatatcttcgatgataaccttagaaaaattctgctcgtggaagcagattgaactgtcatttatcccctccttcttgtaataatgttaccttcagacgcttaaccatatgttctttcttttttctttctcttttcctctctatttttctggtctctccttttcttcttccctccctccctccctccttccctcccatccttatatgcctgtgttactgcaaatctccaattcaaatggaggtgtatatgcctttacttagccaatttaaaaacaggactcaaaatgggagatgtgctgctgaatatgtgtttctttttcttcagtgccatactttgatagcttccaatttgttcactgatataaatgcaaattgggaaaataattaaacctgtatgctgttgatgctgtcagatgtttctgtagcttgctgcttagcataactgagggatgagtaatggaataaggatatgatgtgtaattccactgttgctgtagatggtgacaatctcagttctgatatgttgatgtttgaaagctatttaattgtaaagaaattagtcatgtagagacatgatgtggataaagcatttctggcatttctctagcaggttctagattgaccagtgtcttgcacatgagattatgcatattttttaaggggctgatacttttggttggcctcactgtgtttttcctgatcctgtgggaaagagaaaggcatcccagaagtttgacttgtttttcttttagaatctgtctctgcaggaaagaaaagtcattttaataaaaaccaaaataatttataataattgttgcctttccctccccatcctctccactaagccagcaactaaatgtattcagaaaacaagttaatcaaggagggcagaagaattttttttaaactgtaagaaaatgttcctaagtttagatttattacctgtcatttagggcaaaaatccagtgtccccagcacatgatgacccaactttgtctcacagttgcaagtgtgttgaaaataaagttgctttgtgaacttagaggaaatggctgtgttagattggactgatttagttgcaaaataataccttttagggtcacacttgtattattccctagggtttagccttctctatatacccttggccagactcagaaggggattaaaaagctctggtcttggcctctatcttccttgttgctcctcccagcctttccataacttacccatccacagcccatcagcaggaacacatgagaatgtgggactttgtttctttttttcttagttgtatgaattccagattaggccttatggatacttgtctactaatatatctgaagtttgaaaacaatccctgacaatattgtaggtgcaataaatattagtcaaataaacatttaagtgccaaggtggggtggtagtggttgggggagctttttttgattaaacagaaattccttcaagtagaacttgagaaaggacactaaatacagtcatcttaacccaggccagaacctaaatttattggtttgcctaacagtcttattgtcatggcaatatttgctaagatgagccttctttagataaaaatgaactctcatttagtggtggatgaaaaaagagaaattgctttatcatatagtttaatttggctcggtctactaagaccaccagggttgatgtattcctccatttttggtgtgatctttttcttcattcaataaagttattaaatatatggcaaaacttttttcagtttccagtgaaaatgcatgatactcatgtcatggagtcaggcttgggaaaatctatgaaataatagtttgctgataatgatattttcttatggctttgtatagactacatcctcaaaggattttgtgcttctttgcccatagaaggctttttctccctttgtgtgcttttattaaatctgttgaattatattaatattttttgaatttacagggccaattatcttttttgatggattacttagattaggccatgggttcttcctggcctttctttttctcggtcttttaatcatttcacgtttttatctctccctgagtaaagtggcaagaaaactaaaaatgaaagttaaatgggttgatttgacaatgtgtcaagttctgatttagagtttataaggaaggtagaaacgattggccaaaataagatatttggatgaggattatttaagccgtttagatttggccagagacgccagatttagcaaaggactgggttcttatcttctttcattcatgaatatatgccttgggaggacactggtgattcccacagaattaggccaatgatttgccacattaccctttaagctagcccataattccaccagatcccacaccaagtttcagttcatgactcatactgaataaacgtcagttgtaaatgatgtttgaattggtcttcctactaaagtgaaacatcttcttttaagccaagccacatgaatgaaatagcacaatcagaaaaaaatctttttttttttttttgcatatcaaaccaatggccttctccactaagccagcaactaaaggtattcagaaaacaagttaatcaaggtgggcagaactttttgaactgtgaggaaatgttcctaagtttagatttattacctgtcatttagggcaaaaatctaatgtcttttttatttcttaatcttgtagaactctgtatttcatagtaatgagtacttagggatcattgctctattagcctctgggagagatcttctagagtttgccattcctttttttccaaaattttttgttgttgttgttgttgttttaactgcaactggttacttttctcaaccatggtcctgacatgtttatactatgatacttttgagacttcgctaaagaattaaaagctgtgaaacaacatttgcttctcatccttcagacaaaatgtgttccatttaagcagcatggttaaacactaattttgggataagggagggatatgttttctttactttctttttggatttcatttctgtggcatgagcctatttgcgtttggaaggaaagatgccttcctttacattcttcacactggtaattttttcatactgaattaagaaattatcatcccttcaaaacacatattaatatagcaacattagagtaagggagatggcatttcatctcctctcctcagtcccttgatgttggaatgttattatcatttccaggagccatactttgaaattaaaaacaaattgaggcattaccagtctgatgaaggaattttaaatgcaagccatttaaagaatacttgaaggatttggggagacttaggttaggaaaaagaggggaatacaattagtgcattagaacaagatgctctgtggttcagaggggtggaatgaggcctactgaatgaggccgtagggacacagatttgggttccatgtcagggcgaccattctcaaaaagttggttcactatgggacagtctgcctcaggtaatagcctctgtcaagaggcaaagatgtggagaggatccaattggttggagattggagcaggtgacctattaacctaaattccatgttgtatgtagtactttgcctctcataacatgttcaattaaatatctgttaattcatagctaatgatttttttaatggggcctcgttcttctgccacaagtgcatcccacctttatctttcagggaagaggttggttgcacgttgttaggccaagagactggccctccattatgccctatgctggacttgctttgtcggtccattcattgatgtcctgttgaatcaaaaggtattgttttagtagaagttacatgaagtatattcatttatcacttgctaaacataggccttgctctgtttaataaataatgggtgtctctttcaagattttaggataggcctttttaacagagcagaatcttctgttaaagttctcacaaacagaccaactcccaagagagatgggctggtgggtcactgacataaagcagtccacaagatctattttagaaaagtatcaatgacatttccttagttggtttgattctcttgagaatacatgagtttaaaagaactgaggtcaaattgctttatgtggaaagcaataaaaacaagtatttttgacttgcaaattagaggtaactgtaagcaatttttgctattgaagcctatggcccaaattattccacctgcaaaataactttcacccttgcaaggctgatagacggctcttcattggtctttttttatggttttgttttgtttttttaagtcattggtcttaaatctgtatggtgacaaatctatttgagtttgattgagactttcttggactcctttggacaagaggtcagagcacaaaggctagtcaccacttctttgacttcttgaggtatgagccaaaattttacttttccattgatttaaagcagaatttttggagatgctgtgttctagttcctgacggaatcggtggtggttgctgactttgacactttggagagtgatgtggggagttatatagaaggggaaacactagtttaggtgtgaggagttctagtatgccacaaattagctgagactttagacgaagcacaatatttgagcatcaatcttctcatctatgagatagacctgtcaggattattgtgaaaattagatgagataagttgaaagtacagtgcttggtaaacagttagcactcaaatattagttctttttcactttaattaagagcagactttgaatggtctgatgccaagtgtagatccttaagagacaaaacaaagaaactttcctggcttcaaagaaaagaactccatttctgaaagggtgccttaaaaggaattcatttgtctgatccatccttttgcctttgggcattactactgtcaccctccatttctttacaaacttcaggcaaggtggtctctctctctctcccaataggcaattccagggttgtaaactcattatcaggaagcttaatcttagaactgaaatacctcacagagcaatttaaacctctttcttcttgttcctattcttcatgggaagaaaactgggttgatccctatcttctttttaaggagccacatttgccatttattattgctcttttgcctatttaaaaaaaataacagtcagaaaaaataatgattattaaaatgatagtcattatttacttagtgaatgtcaggataggtatttattactcttagcttcttattggtatcagatgtagatcacggtcttactgttgattaactcttcagttatatatacatactttgattctttagttacataattgataacaaagtgtgcttctgaagaattattctggctgtatggctcttgtttcctccccttggtaaaaatggaggcatgaatctcggttttgtgatctgcttttaatttcatatatgacattatttgatgtacataattaccaacatccaaaagcgtttcttcccctttctacgtgtgcactaaattctaaaacaaaaattggaatacaaaatgcctaataaagaaaaaattcatgtacagaaaagcaaaagataatctactttgttaagataatttgtcactagctggttgaataatgcacagtttttgtttaaggttacacatttatgcctggattaaataacaatagtaaaacttgacaagtcttttgaaaaacagctgctaaacatattgctttctggaatgtaatcattagcaacaaatattctcttattctatacaattgcagaatgctagtggaactttcttgtaggttatttgacaatgaatgttaattgatttattttttaaaaatgtaaaatcctcttatccctttaaggccggtttaggctttcatgtccctgtgatagaaaatttcaaatgctggcttctaatttctactcactgaagtgtcttccagacataccagatggttggagctcctttgatagtatataagggagctacataaatgtatttgaactaactcgtgagcaaaatttctgttttcagcaaaaaaaaaaaaaaaaagaaaaaacaacaaactctgctcaaaatttcagataatacaggagtaaaaagaggtttttgataatctgaagggaaaagtgtgccccatatatcttgtacacacttttaatgcatgacttttagtatagagatgaaataaaatgcaaaatatataattctggagatctcagcagctagttaaaatatttagagaagctgctttatgaagacttagagaatccttgatctcccccacatttcctatcactccattgaaacatggatctttaatattaatacatacatagttttaactaataaacaggttaatcactgagttttatgaactcgattcttgatatttggctattggttttaagcataggatatcagtattatttgtatacagcgttatataaaatctaaccaacttcaatataagaatagtacttgattttaaatgttaatatgcaaatattaacagtatactacatcatattttatgtgttcatatattgatctttttacttaacaaaaagcctgttagaaatataacccactgatgacccgagtccaattagctgaaaaccttctgtagaaaggtgattgtatgaaaaattcaatcaacattaaaaaagggaagtggggagggaatacaaacttgaacaaaatattcttaaatgaagttgcatctctttttaaaattaagatatcattcatgcaccatacggtttatcctattaaggtgtaaacttcaatgtttttaatcatattcactaagttgtgcaacatcaccactccctaacttcagaacactttcatcacctccaaaagaaaccccataccatttgcaatcactcctcctcctccttcccccagcatccggcaaccactaatctactttctgtccctatgaatttgcctatcctggacatttcatatagtcaaacaacatgtggccttttgtgtctggcttctctaagtaagcataatgtttttaaagctcatccatgttgtagcataaatcagtacattgttttcatgtttaaataatattccattgcatgtatatgccacattttatttgtccatttatcatttgatggacatttgggttttttccaccttttgattataataatgctgctgtgaacatttatgtaaaagttttttgtatgggtgtatgttttcacatctctcttaaaaacaattagtctgacaaatcaaatcaaatcatttatgtttatttacgtagaacctcttgcaatcctgtttggagagtgcaacttacgatcttagtttaattgatcaattaggagacctctgaataaagactaactccccaatacatccataagaatttttctatgagcctgtcatttagatgtgataagcaatcaatttcatgaagactgtttcagtcttgtagaaattgagttgccatcacatagaggatttcttgtcctctgcattgtttaaaggacaactacaaatcatgctggataagagtactcattcaatcttttaggattcaatgaagtagcattttaaatatgtaagttattttatatattgtctgtcttttaaaattggactttgcttcttgaaaaaagtttgtcaaatcaccaaaccatatgactgtccattcattgtagcctatgttttctattattaagaaataattcatactgagagtaaaagaaaaagaatgtattttgtgtgcaaaggatgaatgtattaaaaactttttatttgtaacaattttttaaaaaaactaaatggaaattgctttcccatgtacttgtatataaataaacatttcctgttgcccaca

SEQ ID NO: 173155 - DNA, 673 bp, Homo sapiens
  Payload ID: 14032
  Gene Symbol: RAB30
  Gene Name: RAB30, member RAS oncogene family
  ENST ID: ENST00000534103
  CDS Start-End: 374-673
catcgtgtggcccagtctggttgtcaagatagatgctgtgtctagacagtcatctcccttgggaaatcacagttgcttaaaaaggaggcacgtggtctcctgttaagaatacaaaacaggcctgtgagctgttgaggaagaggttgctgcttgaggttgcatgggcctatggagcagggcctggggaaagaagctgtctgcttctatactcatgtgagtctctggatcatggtggtggccttctccttcactcatgtcgggacaactgagtccatggtgcatgggaaggtagagacatagctatcaccttccccagagccagtgatactgtgcctccactgaagattgctgggaggaattgaaagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgcctt

SEQ ID NO: 173156 - DNA, 582 bp, Homo sapiens
  Payload ID: 14032
  Gene Symbol: RAB30
  Gene Name: RAB30, member RAS oncogene family
  ENST ID: ENST00000530224
  CDS Start-End: 471-582
gtatgcagctgtgggcagagagctttggcagaaggaaagactttttgtttttttttaaatgactgtttcataatctgttggctcaaatctgctgctgccacaccctgtgcctctcagggtccctgggtcctgttgcagttatcatatgcctcacctttaacctaaatgactctgcgaagtggctgctatggaaggatttactgagtgcaaaatggattttcttccctgctctttggggcaaagctggctcagagattcttagctgcagggggaggggctggcaggcctgaaccgcagttggacttagcagccaggggttttctggttttcattaaaattctctggctgtcttttgggatagctccattggatatgactgtgcactggagccggttgtgctgttctctcagctgtacacacccatcaaatcacagtgcccctgaggacgagagaaaattgaagctgtgtaaatgagtatggaagattatgatttcctgttcaaaattgttttaattggcaacgctggtgtggggaagacgtgcctcgtccgaagattcactcagctacagatctgggacacag

SEQ ID NO: 173157 - DNA, 495 bp, Homo sapiens
  Payload ID: 14032
  Gene Symbol: RAB30
  Gene Name: RAB30, member RAS oncogene family
  ENST ID: ENST00000524635
  CDS Start-End: 269-495
agtgtagcagcagcaccagggcagggactgactccagcccttggactcaggacatcgcagaccttcccttgcgtgcgtgactcattcgcacatccatttctgtttatgcctggggtggggagaaaaatcccaaaccagctgtgtaaatgagtatggaagattatgatttcctgttcaaaattgttttaattggcaacgctggtgtggggaagacgtgcctcgtccgaagattcactcaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggtaa

SEQ ID NO: 173158 - DNA, 644 bp, Homo sapiens
  Payload ID: 14032
  Gene Symbol: RAB30
  Gene Name: RAB30, member RAS oncogene family
  ENST ID: ENST00000532548
  CDS Start-End: 98-466
gttcccccggagagaaggctggtgcagcttgagctctgtgggcaagtctgactgggcctttctcacttttgcctgtgtttgccttgcagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggtaagtaagggctaacgaggagggaaattgatttgtgggcattagaggatttataatcacataaagcttatacattggtgccttccaagaatatagtctttagctaataattcatgcagtcaaccttcagttcttctgcaattgaagagaaaatgaaataggtcctatcccatggtgacagtttag

SEQ ID NO: 173159 - DNA, 9783 bp, Homo sapiens
  Payload ID: 14032
  Gene Symbol: RAB30
  Gene Name: RAB30, member RAS oncogene family
  Uniprot ID: Q15771
  ENST ID: ENST00000612684
  CDS Start-End: 140-751
actcctctcaacctttttgaggcggagagagggggctgggctgggaaggatgttggggagtgctcttggaaaatctgaggaaggcagaggtgggggactgcagtcctgtcacacacggcccgagagctgagctgtgtaaatgagtatggaagattatgatttcctgttcaaaattgttttaattggcaacgctggtgtggggaagacgtgcctcgtccgaagattcactcagggtcttttccccccaggtcaaggagccacaattggagttgattttatgattaagacagtggagattaatggtgaaaaagtaaagctacagatctgggacacagcaggtcaagagagatttcggtccattacccagagttactaccgaagcgccaatgccttgatcctcacctatgacattacctgtgaggaatccttccgttgccttcctgagtggctgcgggagatagaacaatatgccagcaacaaggtcatcactgtgttagtgggcaacaagattgacctggctgaaaggagagaggtttcccagcagcgagctgaagaattctcagaagctcaggacatgtattatctggagacctcagccaaggaatctgataatgtggagaaactcttccttgacttagcatgccgactcatcagtgaagccagacagaacacacttgtgaacaatgtatcctcacccttacctggagaagggaaaagcatcagctatttgacttgttgtaatttcaactaaaggctgaggcacggagaagaaaaggaatcagcaactgccctgatgggccatgagatgctggggagatctggcgatgactgtggctcccgctctctgaccttctgactcctgtgggctcctgagcttacaaagcatggcaggccaagggcctcgaccacaggccagcattagcagaacatataatggtttcacccttttccagtctggagttggagcaaggagaaaattgcactaggcactccatgatctgcagagcatgttgcttttgtttttttaaaaagcaagtaaaagcgcattcctaaacagagtccggggggaaatgtactgtagggatccctcctgcacatcagtgggtgcatgtgggaactcttctttagggcttcggtggtaatcatctgggggccctggttttcttgtctaccagataaaccaaaactgggaaggccaagtacagtctctgtggtgcgtattgacgaccccatggagattttgaaaagtgttatttctcttgtccacaggcactttcaagaactttgggatgtaaaaatgaaatgaaacctttacccatgaccaacagtaacaatcattgttttaataatatatacaagctccataactccttttggtgctaatgattccgctatttcacagaccaaacgttttagtacattaatgtccttaaatgtgttatatagaaataaaaaaatgggggaagtccatgaatcagcactctttctcaaagtctcattactacctttttaaaggtggatttttgggaaaagagaatacttttccttttatgttcccctctgaatctctaccactttcttgtctctccagccctttatgtaaatgaaaacgtttgcaaaatgaaaaaaataaacaaatggttgatgacattctaatataaaaacttagctctaacacattttgagtagtatgaggaaacagaccagatatgaccaaaatactgtggattaatggactgtagtgcagggctcctagcagagcacagtccttgatagtaggtcacatcttttacttcctggtactctccatcttggacagaccaaggcttaggattttgtagattttttagtatgataagtgagaatagcaacagatgaaaagtctcacgacccatttttatatcttcgatgataaccttagaaaaattctgctcgtggaagcagattgaactgtcatttatcccctccttcttgtaataatgttaccttcagacgcttaaccatatgttctttcttttttctttctcttttcctctctatttttctggtctctccttttcttcttccctccctccctccctccttccctcccatccttatatgcctgtgttactgcaaatctccaattcaaatggaggtgtatatgcctttacttagccaatttaaaaacaggactcaaaatgggagatgtgctgctgaatatgtgtttctttttcttcagtgccatactttgatagcttccaatttgttcactgatataaatgcaaattgggaaaataattaaacctgtatgctgttgatgctgtcagatgtttctgtagcttgctgcttagcataactgagggatgagtaatggaataaggatatgatgtgtaattccactgttgctgtagatggtgacaatctcagttctgatatgttgatgtttgaaagctatttaattgtaaagaaattagtcatgtagagacatgatgtggataaagcatttctggcatttctctagcaggttctagattgaccagtgtcttgcacatgagattatgcatattttttaaggggctgatacttttggttggcctcactgtgtttttcctgatcctgtgggaaagagaaaggcatcccagaagtttgacttgtttttcttttagaatctgtctctgcaggaaagaaaagtcattttaataaaaaccaaaataatttataataattgttgcctttccctccccatcctctccactaagccagcaactaaatgtattcagaaaacaagttaatcaaggagggcagaagaattttttttaaactgtaagaaaatgttcctaagtttagatttattacctgtcatttagggcaaaaatccagtgtccccagcacatgatgacccaactttgtctcacagttgcaagtgtgttgaaaataaagttgctttgtgaacttagaggaaatggctgtgttagattggactgatttagttgcaaaataataccttttagggtcacacttgtattattccctagggtttagccttctctatatacccttggccagactcagaaggggattaaaaagctctggtcttggcctctatcttccttgttgctcctcccagcctttccataacttacccatccacagcccatcagcaggaacacatgagaatgtgggactttgtttctttttttcttagttgtatgaattccagattaggccttatggatacttgtctactaatatatctgaagtttgaaaacaatccctgacaatattgtaggtgcaataaatattagtcaaataaacatttaagtgccaaggtggggtggtagtggttgggggagctttttttgattaaacagaaattccttcaagtagaacttgagaaaggacactaaatacagtcatcttaacccaggccagaacctaaatttattggtttgcctaacagtcttattgtcatggcaatatttgctaagatgagccttctttagataaaaatgaactctcatttagtggtggatgaaaaaagagaaattgctttatcatatagtttaatttggctcggtctactaagaccaccagggttgatgtattcctccatttttggtgtgatctttttcttcattcaataaagttattaaatatatggcaaaacttttttcagtttccagtgaaaatgcatgatactcatgtcatggagtcaggcttgggaaaatctatgaaataatagtttgctgataatgatattttcttatggctttgtatagactacatcctcaaaggattttgtgcttctttgcccatagaaggctttttctccctttgtgtgcttttattaaatctgttgaattatattaatattttttgaatttacagggccaattatcttttttgatggattacttagattaggccatgggttcttcctggcctttctttttctcggtcttttaatcatttcacgtttttatctctccctgagtaaagtggcaagaaaactaaaaatgaaagttaaatgggttgatttgacaatgtgtcaagttctgatttagagtttataaggaaggtagaaacgattggccaaaataagatatttggatgaggattatttaagccgtttagatttggccagagacgccagatttagcaaaggactgggttcttatcttctttcattcatgaatatatgccttgggaggacactggtgattcccacagaattaggccaatgatttgccacattaccctttaagctagcccataattccaccagatcccacaccaagtttcagttcatgactcatactgaataaacgtcagttgtaaatgatgtttgaattggtcttcctactaaagtgaaacatcttcttttaagccaagccacatgaatgaaatagcacaatcagaaaaaaatctttttttttttttttgcatatcaaaccaatggccttctccactaagccagcaactaaaggtattcagaaaacaagttaatcaaggtgggcagaactttttgaactgtgaggaaatgttcctaagtttagatttattacctgtcatttagggcaaaaatctaatgtcttttttatttcttaatcttgtagaactctgtatttcatagtaatgagtacttagggatcattgctctattagcctctgggagagatcttctagagtttgccattcctttttttccaaaattttttgttgttgttgttgttgttttaactgcaactggttacttttctcaaccatggtcctgacatgtttatactatgatacttttgagacttcgctaaagaattaaaagctgtgaaacaacatttgcttctcatccttcagacaaaatgtgttccatttaagcagcatggttaaacactaattttgggataagggagggatatgttttctttactttctttttggatttcatttctgtggcatgagcctatttgcgtttggaaggaaagatgccttcctttacattcttcacactggtaattttttcatactgaattaagaaattatcatcccttcaaaacacatattaatatagcaacattagagtaagggagatggcatttcatctcctctcctcagtcccttgatgttggaatgttattatcatttccaggagccatactttgaaattaaaaacaaattgaggcattaccagtctgatgaaggaattttaaatgcaagccatttaaagaatacttgaaggatttggggagacttaggttaggaaaaagaggggaatacaattagtgcattagaacaagatgctctgtggttcagaggggtggaatgaggcctactgaatgaggccgtagggacacagatttgggttccatgtcagggcgaccattctcaaaaagttggttcactatgggacagtctgcctcaggtaatagcctctgtcaagaggcaaagatgtggagaggatccaattggttggagattggagcaggtgacctattaacctaaattccatgttgtatgtagtactttgcctctcataacatgttcaattaaatatctgttaattcatagctaatgatttttttaatggggcctcgttcttctgccacaagtgcatcccacctttatctttcagggaagaggttggttgcacgttgttaggccaagagactggccctccattatgccctatgctggacttgctttgtcggtccattcattgatgtcctgttgaatcaaaaggtattgttttagtagaagttacatgaagtatattcatttatcacttgctaaacataggccttgctctgtttaataaataatgggtgtctctttcaagattttaggataggcctttttaacagagcagaatcttctgttaaagttctcacaaacagaccaactcccaagagagatgggctggtgggtcactgacataaagcagtccacaagatctattttagaaaagtatcaatgacatttccttagttggtttgattctcttgagaatacatgagtttaaaagaactgaggtcaaattgctttatgtggaaagcaataaaaacaagtatttttgacttgcaaattagaggtaactgtaagcaatttttgctattgaagcctatggcccaaattattccacctgcaaaataactttcacccttgcaaggctgatagacggctcttcattggtctttttttatggttttgttttgtttttttaagtcattggtcttaaatctgtatggtgacaaatctatttgagtttgattgagactttcttggactcctttggacaagaggtcagagcacaaaggctagtcaccacttctttgacttcttgaggtatgagccaaaattttacttttccattgatttaaagcagaatttttggagatgctgtgttctagttcctgacggaatcggtggtggttgctgactttgacactttggagagtgatgtggggagttatatagaaggggaaacactagtttaggtgtgaggagttctagtatgccacaaattagctgagactttagacgaagcacaatatttgagcatcaatcttctcatctatgagatagacctgtcaggattattgtgaaaattagatgagataagttgaaagtacagtgcttggtaaacagttagcactcaaatattagttctttttcactttaattaagagcagactttgaatggtctgatgccaagtgtagatccttaagagacaaaacaaagaaactttcctggcttcaaagaaaagaactccatttctgaaagggtgccttaaaaggaattcatttgtctgatccatccttttgcctttgggcattactactgtcaccctccatttctttacaaacttcaggcaaggtggtctctctctctctcccaataggcaattccagggttgtaaactcattatcaggaagcttaatcttagaactgaaatacctcacagagcaatttaaacctctttcttcttgttcctattcttcatgggaagaaaactgggttgatccctatcttctttttaaggagccacatttgccatttattattgctcttttgcctatttaaaaaaaataacagtcagaaaaaataatgattattaaaatgatagtcattatttacttagtgaatgtcaggataggtatttattactcttagcttcttattggtatcagatgtagatcacggtcttactgttgattaactcttcagttatatatacatactttgattctttagttacataattgataacaaagtgtgcttctgaagaattattctggctgtatggctcttgtttcctccccttggtaaaaatggaggcatgaatctcggttttgtgatctgcttttaatttcatatatgacattatttgatgtacataattaccaacatccaaaagcgtttcttcccctttctacgtgtgcactaaattctaaaacaaaaattggaatacaaaatgcctaataaagaaaaaattcatgtacagaaaagcaaaagataatctactttgttaagataatttgtcactagctggttgaataatgcacagtttttgtttaaggttacacatttatgcctggattaaataacaatagtaaaacttgacaagtcttttgaaaaacagctgctaaacatattgctttctggaatgtaatcattagcaacaaatattctcttattctatacaattgcagaatgctagtggaactttcttgtaggttatttgacaatgaatgttaattgatttattttttaaaaatgtaaaatcctcttatccctttaaggccggtttaggctttcatgtccctgtgatagaaaatttcaaatgctggcttctaatttctactcactgaagtgtcttccagacataccagatggttggagctcctttgatagtatataagggagctacataaatgtatttgaactaactcgtgagcaaaatttctgttttcagcaaaaaaaaaaaaaaaaagaaaaaacaacaaactctgctcaaaatttcagataatacaggagtaaaaagaggtttttgataatctgaagggaaaagtgtgccccatatatcttgtacacacttttaatgcatgacttttagtatagagatgaaataaaatgcaaaatatataattctggagatctcagcagctagttaaaatatttagagaagctgctttatgaagacttagagaatccttgatctcccccacatttcctatcactccattgaaacatggatctttaatattaatacatacatagttttaactaataaacaggttaatcactgagttttatgaactcgattcttgatatttggctattggttttaagcataggatatcagtattatttgtatacagcgttatataaaatctaaccaacttcaatataagaatagtacttgattttaaatgttaatatgcaaatattaacagtatactacatcatattttatgtgttcatatattgatctttttacttaacaaaaagcctgttagaaatataacccactgatgacccgagtccaattagctgaaaaccttctgtagaaaggtgattgtatgaaaaattcaatcaacattaaaaaagggaagtggggagggaatacaaacttgaacaaaatattcttaaatgaagttgcatctctttttaaaattaagatatcattcatgcaccatacggtttatcctattaaggtgtaaacttcaatgtttttaatcatattcactaagttgtgcaacatcaccactccctaacttcagaacactttcatcacctccaaaagaaaccccataccatttgcaatcactcctcctcctccttcccccagcatccggcaaccactaatctactttctgtccctatgaatttgcctatcctggacatttcatatagtcaaacaacatgtggccttttgtgtctggcttctctaagtaagcataatgtttttaaagctcatccatgttgtagcataaatcagtacattgttttcatgtttaaataatattccattgcatgtatatgccacattttatttgtccatttatcatttgatggacatttgggttttttccaccttttgattataataatgctgctgtgaacatttatgtaaaagttttttgtatgggtgtatgttttcacatctctcttaaaaacaattagtctgacaaatcaaatcaaatcatttatgtttatttacgtagaacctcttgcaatcctgtttggagagtgcaacttacgatcttagtttaattgatcaattaggagacctctgaataaagactaactccccaatacatccataagaatttttctatgagcctgtcatttagatgtgataagcaatcaatttcatgaagactgtttcagtcttgtagaaattgagttgccatcacatagaggatttcttgtcctctgcattgtttaaaggacaactacaaatcatgctggataagagtactcattcaatcttttaggattcaatgaagtagcattttaaatatgtaagttattttatatattgtctgtcttttaaaattggactttgcttcttgaaaaaagtttgtcaaatcaccaaaccatatgactgtccattcattgtagcctatgttttctattattaagaaataattcatactgagagtaaaagaaaaagaatgtattttgtgtgcaaaggatgaatgtattaaaaactttttatttgtaacaattttttaaaaaaactaaatggaaattgctttcccatgtacttgtatataaataaacatttcctgttgcccaca

SEQ ID NO: 173160 - DNA, 4055 bp, Homo sapiens
  Payload ID: 14033
  Gene Symbol: RAB31
  Gene Name: RAB31, member RAS oncogene family
  Uniprot ID: Q13636
  ENST ID: ENST00000578921
  CDS Start-End: 242-829
ccgtccgggggcgttcctgggagctgggggccggcgaggctggacccgacgcgcccgggaggagccggccggcggccacgtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatggaggggatgtagttgcatttttgctaaaaaaaaaaaaaaacctttaaaaattgttggatgtgtacaaaagtcttactgccttattatgtgtatgggattctaaagtggcattccacttggatttcctgtgctacctatccaaattccagtaactacttcagtgtcattgcctttgttacctaaccaaccttcactgaaaggcaaatttagttcaggaggttagtttttagctagctttggaagtaagcctttatttattactttttggaggaaatcagagaagtgtcaatggaccgtcactcagactgagacttgagttattacagaagccaggaaaagtgtattagaaactgttgtctacaccacttttaattggtgaacaatttttctaagttatggtcatatatacccaaacaaaccaaatcaaactaaattactgcatataattttgggattgggtggcctagtttgaaagagtgatttaagtaatcactatgtaagtggtgagagatgcaggacatacacattattcaagagaccacctgacatgcatctcctccgcaggaatacattcgtcctctcttagagaagtttaacgcacatagtattattttactaagagaatatctcttggtgtcatatctaggggaagagaattaactagaattaaatttaatgtttgaatctaaatcattgggcaaacttctaataataacaattaataataggttacaggaaagccagccagaggaagtgtcagcactttaaaattctagaccccaaaaaactacaaaatcagaaaaagtatttttatgtttctagcttgaggagaagggctttagggctaaccagaggtctgaccctagaatgccaaggaactgagaatgggctccgatgaaaaccttccttttcagattccctgtctgctcaattaaagatgtttgaatccaaaggaagtcaaggaagaaaaagcatggaaaggaagagaactgattcctactgaaaattcaaattctattaccattctaactttcataaaaagttgggatcaagaagcagctgatttcctgccagggcttatattagggggtgattcttaaaggacattaggattggtgctcagaaatggttaatcatgctgtgtgctagccagggccagctggtaccttctttgccatgagcattcaagggacggctaacctttattgacaatctatatcgcaaaagtcaggaaagaggttgtgagctgattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaaaggtaaaaaaaaaaaaaaaaaaatgagttgaaaattgaagtgacctctttccagctgagttgcaggcttattttgtaacctttcctcatccagttttccctgagaacctgggtttatctctagatagctgttcaggttttttagctgaggggtaagtatcctagctgagagttttgcatctttgggctgggtttgcagtggttgtgttttgcataaaatgtctagtctttgccacagatagtgagctacccactaatgagcccatggttttatttcagaagcacatgagggtgtgaaaccactctgttacctttctgtattgtcttagctattcaagccagtcagaggataatatatatattctcatcagcactcagagtagtcagtgaagagagtagatcacacttgggcacaccaggattcacataaacattgtatcttctctgtggatgctcaggccttgtctacaatgaggctttacaaccttcctttgttttggctcgggattacttcctggctgtctaataattgaaccataaccatgtaatattatgtaaaggcctggaaattactgttgctaaaaaaagtcatgtagtttcatgtagtgtagcatccttggcatcgttttccaaaatttgttccttctcccttttttttttctttcgtgtgtggcatgagtgtgtatctgtgtaaatatgattgtatatgtgttactccgatatgtaatccatttcactggctgagtttggcccctagccatgtgttaatataaagtaggcatggcttcccaatggaaatctctgagaatgacagtggagttgtgcaagcattttacattgccacataattgacttgccattttatggttaaaaacggcacattaggcagttgaatatgacgttaccttgcagactaaaaggttgaaggcccgaaactaacttttagctaacaataagggctgtgccccaatggaaactgagttcattttctgagaaaggtttggatgactgaaatatttcctctacagtcaaggactttggcatgtggtggctgaaactgagcttttttgtgtgggctccagttctcactgttctgcaatgctcatggcaagttgaatggtgagctagcttataaattaaagagctctgaactgtattcagaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatactaataaatattttcagtttta

SEQ ID NO: 173161 - DNA, 783 bp, Homo sapiens
  Payload ID: 14033
  Gene Symbol: RAB31
  Gene Name: RAB31, member RAS oncogene family
  ENST ID: ENST00000578734
  CDS Start-End: 132-209
aaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcgggggcatcttttatgaccaaaactgtgccttgtggaaatgaacttcacaagttcctcatctgggacactgctggtcaggaacggtttcattcattggctcccatgtactatcgaggctcagctgcagctgttatcgtgtatgatattaccaagcaggattcattttataccttgaagaaatgggtcaaggagctgaaagaacatggtccagaaaacattgtaatggccatcgctggaaacaagtgcgacctctcagatattagggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagttgagaagccaaccatgcaagccagccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcaggggg

SEQ ID NO: 173162 - DNA, 714 bp, Homo sapiens
  Payload ID: 14033
  Gene Symbol: RAB31
  Gene Name: RAB31, member RAS oncogene family
  ENST ID: ENST00000583137
  CDS Start-End: 84-263
agaggcgagagacgccggcggggcgcgggcgcggcggccccggaggatgctgctgagccccggcactgcctggctgcgagcacatgatggcgatacgggagctcaaagtgtgccttctcgggggactgatggaaccgatctgttcccttacgaagtgtcacagtattggcaggactctggacaaggacaaggaaggctgcattcctgtggcaccaccaggtggaagatggaggtatgttctcagaacacctgcgactgggtaatatataaagaaattggctcacgattctggtggctggaaagtccaggacggggcagctgcatctggtgagggcctcagtctgcttccactcatggcagaaagtggaagcgaagtgggtgtgtgcaaagagatcacatggtgtgaaggacagaggcttagccatgtgaaatgtttttgctcaatgtcataaaggccatgtgggaagtggaccctaagccaggcagtgtgactgctccagggttcccagctccacagtgcaggaggtcaaaacaaccttgatgttatcgtacttaccgtaaatcttgctgtaaagcagttgttccgcacatcccttctgaagcacggacactgtccccctgtggtgcgtaagccctgggcctggggatggtagcacagggatcccccatttcgcctgtgggccacccgagacgcggctcctgttcatacgtccc

SEQ ID NO: 173163 - DNA, 469 bp, Homo sapiens
  Payload ID: 14033
  Gene Symbol: RAB31
  Gene Name: RAB31, member RAS oncogene family
  ENST ID: ENST00000581109
  CDS Start-End: 100-324
ggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgtccaggatcactttgaccacaacatcagccctactattggggcatcttttatgaccaaaactgtgccttgtggaaatgaacttcacaagttcctcatctgggacactgctggtcaggaacggggaggttcccctgaaggatgctaaggaatacgctgaatccataggtgccatcgtggttgagacaagtgcaaaaaatgctattaatatcgaagagctctttcaaggaatcagccgccagatcccacccttggacccccatgaaaatggaaacaatggaacaatcaaagtt

SEQ ID NO: 173164 - DNA, 1217 bp, Homo sapiens
  Payload ID: 14034
  Gene Symbol: RAB32
  Gene Name: RAB32, member RAS oncogene family
  Uniprot ID: Q13637
  ENST ID: ENST00000367495
  CDS Start-End: 180-857
ggccgcgagcactggcgggttctgggtcctgtgaccggtcaggcggcgtcagcgggcgcggcggagggctggccggcctcgggggagtttccgcggccgccgggggcgcggcggcagagcgcgaggccgggcagggggccagactcggagtcgaggcgcgcccgacagccgcagcgctcatggcgggcggaggagccggggaccccggcctgggggcggccgccgccccagcgcccgagacccgcgagcacctcttcaaggtgctggtgatcggcgagcttggcgtgggcaagaccagcatcatcaagcgctacgtccaccagctcttctcccagcactaccgggccaccatcggggtggacttcgccctcaaggtcctcaactgggacagcaggactctggtgcgcctgcagctgtgggacatcgcggggcaggagcgatttggcaacatgacccgagtatactacaaggaagctgttggtgcttttgtagtctttgatatatcaagaagttccacatttgaggcagtcttaaaatggaaaagtgatctggatagtaaagttcatcttccaaatggcagccctatccctgctgtcctcttggctaacaaatgtgaccagaacaaggacagtagccagagtccttcccaggtggaccaattctgcaaagaacatggctttgccggatggtttgaaacctctgcaaaggataacataaacatagaggaagctgcccggttcctagtggagaagattcttgtaaaccaccaaagctttcctaatgaagaaaacgatgtggacaaaattaagctagatcaagagaccttgagagcagagaacaaatcccagtgttgctgatatatggcttctgcttctcttgtgtgtgcctcagctctgaagaagttcctgagaatgggttacagatgtcatgttagctgggagtcttcccacatgtggcacttcaaaaggcagcaccactgggcgcctgcacttatttgaaaatggaactttgggagaagtatccctgctagtggctctgtaacttaacagatgacaattaggcttttgtcattgttgccatcatatggaagataatgtttacatccttttaaacatttttatatgacaattcctcaggatttggtaaggcttccaagttgtagcttttagtgtaagtgctggggtggtaataaaatgttacctccagtcttatggtca

SEQ ID NO: 173165 - DNA, 1258 bp, Homo sapiens
  Payload ID: 14035
  Gene Symbol: RAB33A
  Gene Name: RAB33A, member RAS oncogene family
  Uniprot ID: Q14088
  ENST ID: ENST00000257017
  CDS Start-End: 415-1128
cgggtccgtcccgggaatgcaggcaggggagggtgtgggccgaggcgcggcggcggctggagcagcgcggtagggtccttcgccagagcatccggtccgagggcgcacacaggcagaaggctcgcggctcgtccactctcctccctctctcctcctctccctggcttttgtgttggtgcctccgagctgcaaggagggtgcgctggaggaggaggaggggggcccggagtgagaggcacccccttcacgcgcgcgcgcgcacacggtgccggcgcacgcacacacgggcggacacacacacacgcgcgcacacacacacgcacagagctcgctcgcctcgagcgcacgaacgtggacgttctctttgtgtggagccctcaaggggggttggggccccggttcggtccgggggagatggcgcagcccatcctgggccatgggagcctgcagcccgcctcggccgctggcctggcgtccctggagctcgactcgtcgctggaccagtacgtgcagattcgcatcttcaaaataatcgtgattggggactccaacgtgggcaagacctgcctgaccttccgcttctgcgggggtaccttcccagacaagactgaagccaccatcggcgtggacttcagggagaagaccgtggaaatcgagggcgagaagatcaaggttcaggtgtgggacacagcaggtcaggaacgtttccgcaaaagcatggtcgagcattactaccgcaacgtacatgccgtggtcttcgtctatgacgtcaccaagatgacatctttcaccaacctcaaaatgtggatccaagaatgcaatgggcatgctgtgcccccactagtccccaaagtgcttgtgggcaacaagtgtgacttgagggaacagatccaggtgccctccaacttagccctgaaatttgctgatgcccacaacatgctcttgtttgagacatcggccaaggaccccaaagagagccagaacgtggagtcgattttcatgtgcttggcttgccgattgaaggcccagaaatccctgctgtatcgtgatgctgagaggcagcaggggaaggtgcagaaactggagttcccacaggaagctaacagtaaaacttcctgtccttgttgaaaccaaacgatataaatacaagataaattatcactggagttttttctttcccttttttctgtgcctgcataatgctgacacctgcttgtttccatacaaattgatatcaaaataaaatttgtatagatta

SEQ ID NO: 173166 - DNA, 4562 bp, Homo sapiens
  Payload ID: 14036
  Gene Symbol: RAB33B
  Gene Name: RAB33B, member RAS oncogene family
  Uniprot ID: Q9H082
  ENST ID: ENST00000305626
  CDS Start-End: 390-1079
gcttcctccagagggcgggaaccttggacgtggcggggctgggtcagtcagggcgctgggcccagcctctctgcaggctggccttccgcgctgccgtgaagcccccgacaggtcccacgcctgcctaggtagaccggcgccagcccgagtgacgcctggcgtgtggccgcgggcaggcggctccgtgcggcggggcgggcgggtgccacacctgtgcgggcaagggcggggcgggaaggtgcgcaggcgcgctcggggctggtgggcggtggctcctgggaagttgcgcagccgaactggccggctgggcgcgcgctcttgcggtggcgtaatctctcagcctttctgtgtctcctttcctccgcctcagtttggggcgggtcgggggaatggctgaggagatggagtcgtcgctcgaggcaagcttttcgtccagcggggcagtgtcaggggcctcagggtttttgcctcctgcccgctcccgcatcttcaagataatcgtgatcggcgactccaatgtgggcaagacatgcctgacctaccgcttctgcgctggccgcttccccgaccgcaccgaggccacgataggggtggatttccgagaacgagcggtggagattgatggggagcgcatcaagatccagctatgggacacagcaggacaagaacgattcagaaagagcatggttcagcactactacagaaatgtacatgctgttgtcttcgtgtatgatatgaccaacatggctagttttcatagcctaccatcttggatagaagaatgcaaacaacatttgctagccaatgatataccacggattcttgttggaaataaatgtgacttgagaagtgccatacaggtacccacagacttggcacaaaaatttgctgacacacacagtatgcctttgtttgaaacgtctgctaaaaaccccaatgataatgaccatgtggaagctatatttatgaccttggctcataagcttaagagccacaaaccattaatgcttagtcagccccctgataatggaattatcctgaagcctgaaccaaagcctgcaatgacgtgctggtgctaaataacagtctttattatattatctaattttgactaaagaaatacttttgaagtatgacagtattaagtcataagatttaatctcaactataatgggtcatcttgacactttgctgtttgtcattgtcacgcttttgtattttgtatctacttaagtttgtcactgtgacaacacaggaaaagttggttttcaggtgagattgaaaatgaagcaaagataggatgaatctgaacatctctccatctagagcccaatgaaggaagcttcaaatgagaacatgatggaatcagtaaccattcaatcttttgtcctaggattggaaaaaaatgttaaaggtttaggacacacctaatagtatgtcctttgaatgggaagtgttcttaataggataaaaactggtatttgcctctccccagagtactttttttgttttttcatagagacggggtcttgctatgttgtccaggctggccttgagctcctgggctcaagcaatcctcccacctcagcctccccagtactgggactgtaggtactcaccactgcatctggcctttctttgttttattaacatatttagttttgttattattggtatgttttagagccaagactttagttccagtgggataagaaggcatagaatgttttctggttcccagtccataaagaatgacttttccaagagttctagatgtttgattttctaattaatacttatcagatctacaaaaatcattattattttaaaagagttatttgagtttctttctttctttttttttttttttttttttgagatggagtctcgctctgtctccaggctggagtgcagtggcgtcatctcggctcactgcaacctccgcctcccaggttcaagtgattctcctgcctcagcctcccgagtagctgggattacaggcgtgcactaccacacccagctgatttttgtatttttagtatagatggggtttcaccatgttggccaggatggtctcgatctcttgacctcatgatccacccgcctcagcttcccaaagtgctgggattacaggtgtgagtcactgcacccagccgagttgctttcttactaaatcctattaaaatatgcaaaaataagtcagattttaaggcaaataaagtgacataaggtgctttatattttattttggtatatttaaacagtgaaaaactaactgaaagcacatgaagagttgtaacttgggggaaaataggtaaacatagcttctagctaacacaggagacctattcttagcctttactaatttcaagcagtgtatcccatatggtatctcttgctcttccttcaactccaataaatttaatgactaaatgccaagttaacaaatcaacttccatttggattgtaggtgtgaaggcacaactctaattgctattagtctacatgtatttctgtaatagtattgtgtcatatcaatttttaagatgtctaaattttatggtcacaagttatccctcctcagtatgaaaaataaattagatattgaaaaatgtctaaacttcagtgatggaaagaatatttcaagaagttttttaacctaaatacttttattttgaatttaagtctttgcacataaaatatagcaagcttacatattaaactatttacgtaaatggaatgtaagccatgactttaactgaagtgttcacattcactaattttgatagattgctgtccttaataattttggaggaaattaagccaaatgattattgtactacagtattttcagaatatgggaaatcaattaaaaatgtaatctaatctagtttaagatttttgtttaatcatcatggtggtcctacctggataatttaactataaagacaaagtaattctattaaatgaactaactgaaaataataattataggaagtgattattccattttaagtattagagctcaaattggctttatttgcatttagggagatcatgttttcttaatcatgctggaatttaaaaattgttttacttgtatcgaaattaaccttgatttataactatttttgtaataaaacaatgacagctgtagtaactatgatgggtgtaacaacatttttttaaagaagggaatctgtttatcgcttttcaaaatattttctaaagtgggggaagaaagtttatagactttccaagcacatttatggttttttattactattattatggttttaaaaagagtaactttatttctttttgtaaggaattaagtaatatcctttacagttctgtgaaaggacttattttttaactgtaatatttattagttttaaaatatttgtatctcatttgtaacaatttgttttaattttttatatatatgtttttatttttaaaaaacataccagttgaatggggttaaagctttcaatatcttaaaatatttataaaacatttcactgttgcaaaatcacttccaaaatgatagctatctaacaactaattactaatttttaaagaacaaatcacacatttaaaaaatctgtagaatttattttaactatgacctttaattgaaaataaataattaaaatatcagacatgttttggaaaagtcttaatttgagaacaccaaaggaaactaccccagaatctaatgtagttcgctattaataacaatgcattattgaaagtatattgcaaatacatgtttcctcatgaaatctaagtaattttgttgtggaatagtgtcactgttacatttcccccatgaagttcaataaaccagcttagccacaaagaaattgtgttttattttctttgtttggttactgggtagagtataaaataaaacaatctttttttcctcctggtttccagataatattatatatatgatacacttttgaaaacaacaaaaagcccccaacccattggacaattattttcttgtatacatttgaggtcaaagaacacttcaggaaaaaaactcaacaaagtattaaaattagctgataacacagcttttgtatttgtgtgttttagtaatccagcttgttttagaatagttcagtgcaaaaagcaaatggtgcaagaggagttgatgtgtatttagacgtaaaagcatttaacagaatgaataactatagaaagtatgagaaaagagaacgaactacgtctcaggtataagattgcagttactgatttagacaccataggattagggatgtgggggcctctgatgttgattctgcttcccctggtcagtttattttacgtataagttacccttgtgttcaaacacaaaattgacattattcatgaaggactgctttcttaatcagatattaagaagttcgtcatgtattttgggagcacgtttgctacagcctgtgtggcaagggcgaatgcacttggtttgttggaataacctgatttatcaaacatttatcaagtatgggtcatgtgttctctatttgtgttagtggagctacata

SEQ ID NO: 173167 - DNA, 1060 bp, Homo sapiens
  Payload ID: 14037
  Gene Symbol: RAB34
  Gene Name: RAB34, member RAS oncogene family
  ENST ID: ENST00000353676
  CDS Start-End: 429-1060
ctccttgggccccttctctccccctttcccctccctgctggttcctggcatcgccagatgctgcgcagcagtctccgattccccatcaccaattcggctggggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccg

SEQ ID NO: 173168 - DNA, 1592 bp, Homo sapiens
  Payload ID: 14037
  Gene Symbol: RAB34
  Gene Name: RAB34, member RAS oncogene family
  Uniprot ID: Q9BZG1
  ENST ID: ENST00000301043
  CDS Start-End: 454-1233
cagccttgaaggaaaagacgccagacttcagacgtctctctcctcggtgggcacctcattctaaccctggcacccccttcgcacgcttcccctccaccatcctcacccccgacctcccagggcagaagggcgagagggggcagactctatgagtcacctcccaggcctggagttgaggagggaagcgccgcctctccttgggccccttctctccccctttcccctccctgctggttcctggcatcgccagatgctgcgcagcagtctccgattccccatcaccaattcggctggcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 173169 - DNA, 1713 bp, Homo sapiens
  Payload ID: 14037
  Gene Symbol: RAB34
  Gene Name: RAB34, member RAS oncogene family
  ENST ID: ENST00000395242
  CDS Start-End: 586-1368
cgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggcagatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaattt

SEQ ID NO: 173170 - DNA, 1597 bp, Homo sapiens
  Payload ID: 14037
  Gene Symbol: RAB34
  Gene Name: RAB34, member RAS oncogene family
  Uniprot ID: Q9BZG1
  ENST ID: ENST00000395243
  CDS Start-End: 483-1238
cgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 173171 - DNA, 1736 bp, Homo sapiens
  Payload ID: 14037
  Gene Symbol: RAB34
  Gene Name: RAB34, member RAS oncogene family
  Uniprot ID: Q9BZG1
  ENST ID: ENST00000395245
  CDS Start-End: 628-1407
tccaggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgcc

SEQ ID NO: 173172 - DNA, 1184 bp, Homo sapiens
  Payload ID: 14037
  Gene Symbol: RAB34
  Gene Name: RAB34, member RAS oncogene family
  Uniprot ID: Q9BZG1
  ENST ID: ENST00000450529
  CDS Start-End: 71-826
gatgctgcgcagcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagc

SEQ ID NO: 173173 - DNA, 1201 bp, Homo sapiens
  Payload ID: 14037
  Gene Symbol: RAB34
  Gene Name: RAB34, member RAS oncogene family
  ENST ID: ENST00000422279
  CDS Start-End: 128-643
ccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagttccaagaaggatctgagtacccctgctcagtatgcgctgatggagaaagacgccctccaggtggcccaggagatgaaggctgagtactgggcagtctcatctctcactggtgagtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgtt

SEQ ID NO: 173174 - DNA, 717 bp, Homo sapiens
  Payload ID: 14037
  Gene Symbol: RAB34
  Gene Name: RAB34, member RAS oncogene family
  ENST ID: ENST00000412625
  CDS Start-End: 86-717
cacaatctacacagcagccttgaaggaaaagacgccagacttcagacgtctctctcctcgggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccg

SEQ ID NO: 173175 - DNA, 863 bp, Homo sapiens
  Payload ID: 14037
  Gene Symbol: RAB34
  Gene Name: RAB34, member RAS oncogene family
  Uniprot ID: Q9BZG1
  ENST ID: ENST00000436730
  CDS Start-End: 66-845
tgcgcagcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttc

SEQ ID NO: 173176 - DNA, 914 bp, Homo sapiens
  Payload ID: 14037
  Gene Symbol: RAB34
  Gene Name: RAB34, member RAS oncogene family
  ENST ID: ENST00000430132
  CDS Start-End: 139-914
ggaaaagacgccagacttcagacgtctctctcctcggtgggcacctcattctaaccctggcacccccttcgcacgcttcccctccaccatcctcacccccgacctcccagggcagaagggcgagagggggcagactctatgagtcacctcccaggcctggagttgaggagggaagcgccgcctctccttgggccccttctctccccctttcccctccctgctggttcctggcatcgccagatgctgcgcagcagtctccgattccccatcaccaattcggctggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgccc

SEQ ID NO: 173177 - DNA, 1293 bp, Homo sapiens
  Payload ID: 14037
  Gene Symbol: RAB34
  Gene Name: RAB34, member RAS oncogene family
  Uniprot ID: Q9BZG1
  ENST ID: ENST00000415040
  CDS Start-End: 222-935
ggttcctggcatcgccagatgctgcgcagcagtctccgattccccatcaccaattcggctggcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtggggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgccagcaagaagaagcccacatgttgcccatgagggctgaggagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagc

SEQ ID NO: 173178 - DNA, 1099 bp, Homo sapiens
  Payload ID: 14037
  Gene Symbol: RAB34
  Gene Name: RAB34, member RAS oncogene family
  ENST ID: ENST00000453384
  CDS Start-End: 2-808
tatgagtcacctcccaggcctggagttgaggagggaagcgccgcctctccttgggccccttctctccccctttcccctccctgctggttcctggcatcgccagatgctgcgcagcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggcagatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagcactt

SEQ ID NO: 173179 - DNA, 467 bp, Homo sapiens
  Payload ID: 14037
  Gene Symbol: RAB34
  Gene Name: RAB34, member RAS oncogene family
  ENST ID: ENST00000583538
  CDS Start-End: 1-467
agatgctgcgcagcagtctccgattccccatcaccaattcggctggtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttacccctgctcagtatgcgctgatggagaaagacgccctccaggtggcccaggagatgaaggctgagtactgggcagtctcatctctcactggtgagaatgtccgagaattcttcttccgtgtggcagcactgacctttgaggccaatgtgctggctgagctggagaaatcgggggctcgacgcattggggatgttgtccgcatcaacagtgatgacagcaacctctacctaactgcc

SEQ ID NO: 173180 - DNA, 626 bp, Homo sapiens
  Payload ID: 14037
  Gene Symbol: RAB34
  Gene Name: RAB34, member RAS oncogene family
  ENST ID: ENST00000419712
  CDS Start-End: 179-626
agatgctgcgcagcagtctccgattccccatcaccaattcggctggggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatg

SEQ ID NO: 173181 - DNA, 582 bp, Homo sapiens
  Payload ID: 14037
  Gene Symbol: RAB34
  Gene Name: RAB34, member RAS oncogene family
  ENST ID: ENST00000580843
  CDS Start-End: 428-582
agatgctgcgcagcagtctccgattccccatcaccaattcggctgggaaccatccggccccgcgtaatcgtaggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggcagatttaa

SEQ ID NO: 173182 - DNA, 546 bp, Homo sapiens
  Payload ID: 14037
  Gene Symbol: RAB34
  Gene Name: RAB34, member RAS oncogene family
  ENST ID: ENST00000582934
  CDS Start-End: 401-546
agatgctgcgcagcagtctccgattccccatcaccaattcggctgggaactatccggccccgcgtaatcgtagggtctgcgcgggcccggcccccaccagacgggactccccgcccccaattggcggccgaagagtctcctcgccccagagtcatcttcgggacgcccagggcccgggtgattttgggctcgccgcggccccgggtgattgtttcatctccgtggcccgcggtggtcgtagcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtggg

SEQ ID NO: 173183 - DNA, 994 bp, Homo sapiens
  Payload ID: 14037
  Gene Symbol: RAB34
  Gene Name: RAB34, member RAS oncogene family
  ENST ID: ENST00000625712
  CDS Start-End: 71-706
gatgctgcgcagcagtctccgattccccatcaccaattcggctggggcgccctgcaaggccgcaggcaggatgaacattctggcacccgtgcggagggatcgcgtcctggcggagctgccccagtgcctgaggaaggaggccgctttgcacgggcacaaagacttccacccccgcgtcacctgcgcctgccaggagcaccggacaggcaccgtgggcagatttaagatctccaaggtcattgtggtgggggacctgtcggtggggaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggaacataccaagcagtggctggccgatgccctgaaggagaatgacccttccagtgtgcttctcttccttgtaggttccaagaaggatctgagtacccctgctcagtatgcgctgatggagaaagacgccctccaggtggcccaggagatgaagactgttcagagactgcccagccctagggcactgtgccaccctcattcctccagagcttgacccctggacatttgcactgactttatccagaccaaagagctgcctcttggtggcagtattcccacagaggggtagctgggatcatgctagtcacttcctgcccccaggcaccgtgccaaagactggatgccccctactcctcaggggactgtccagggcgcccagtggtagtgagggagagtgtctctgttcttttgctcagcctgctgggccctttgtgtttgaggatgcttaatgattccagcctctcactgtgccttatgcattaaaatttctttgttacgagca

SEQ ID NO: 173184 - DNA, 2945 bp, Homo sapiens
  Payload ID: 14038
  Gene Symbol: RAB35
  Gene Name: RAB35, member RAS oncogene family
  Uniprot ID: Q15286
  ENST ID: ENST00000229340
  CDS Start-End: 190-795
aaggagggaggcggtggtagcggcggcggctgctgaggaggaggagggggagcggagggaggtgtttctgtcagttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgtgggcaagagcagtttactgttgcgttttgcagacaacactttctcaggcagctacatcaccacgatcggagtggatttcaagatccggaccgtggagatcaacggggagaaggtgaagctgcagatctgggacacagcggggcaggagcgcttccgcaccatcacctccacgtattatcgggggacccacggggtcattgtggtttacgacgtcaccagtgccgagtcctttgtcaacgtcaagcggtggcttcacgaaatcaaccagaactgtgatgatgtgtgccgaatattagtgggtaataagaatgacgaccctgagcggaaggtggtggagacggaagatgcctacaaattcgccgggcagatgggcatccagttgttcgagaccagcgccaaggagaatgtcaacgtggaagagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttgtcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaattattttctttccctgaggtttgattggcacagcagcaaaagttgaggccaccccacttgtgtccactgtttttagaaaaaaatgaatggcttcctgccattgtggggctggactcttgggctttcttggtgggagcggagaaggggcctcccacccttgtccgagttgcctcccactggaggtcaggagtctacactgcagcctcgggcactgtggggagtgcatgcctggggcctctgggtggggaccatggacaggccctggtcactgtcctaacctttgtcaggacaaaggtagcaagaggatttcctggcgggtgggaaggaatggctggggcggccagttttgacacgccccagtgccctggagaacaaccagggtcatctgcacttgatgactgctccccgacccccagcccggacacctcattcccctcccactacagggatcaagtgacctgggaagaaccgagtttaacaccaggatgtgtttccttagatttcctttcctaggcgatttccagggagagccctgattggacaatcacatcacagatcacactgcagtttccatgttagcactgtggatgggtttttaatcaataaaaactgggggtttcttctcaccgactctccacttgcccaaactgccaaaagctggtgattctgggacaggccttcactttggagccacgggatggggtgggggagccccatgggcctgggaaggagggtgctgtggagggggctgcagggctgaccagcaggcagcctcatctggtcgggggcgggggcggcaggagcagaagcggggtctccgtccttgggactgtcctggttggccacgggccctgaggatgcacggtgcctggggctcctgtgccggtgggcggggggcatgctggcctctgagcgatcaggcgaggccagcgagggtgtgcttgcaaattcaagcaataagaggggggttcctgggggcttccagcccaggctagaagcccccatggcttctggcagctggacatcagccccaggtattggggtgattttggtcatgacagtgtgcctgtcccactgttacacgcatgaatgggggttatggggtgggggtggggactcagggctggaccgacgtcctagtggacctgatgtgaaattcctgtcaaacaaacaccacttttcaatggtttgctaggagtatttctgtattgaaagtttctaattatgctttttaaaaaaatactaaaaataaaggttcaagctgccaaatttt

SEQ ID NO: 173185 - DNA, 939 bp, Homo sapiens
  Payload ID: 14038
  Gene Symbol: RAB35
  Gene Name: RAB35, member RAS oncogene family
  Uniprot ID: Q15286
  ENST ID: ENST00000534951
  CDS Start-End: 118-576
agttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgtgggcaagagcagtttactgttgcgttttgcagacaacactttctcaggcagctacatcaccacgatcggagtggatttcaagatccggaccgtggagatcaacggggagaaggtgaagctgcagatctgggacacagcggggcaggagcgcttccgcaccatcacctccacgtattatcgggggacccacggggtcattgtggtttacgacgtcaccagtgccgagtcctttgtcaacgtcaagcggtggcttcacgaaatcaaccagaactgtgatgatgtgtgccgaatattagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgcc

SEQ ID NO: 173186 - DNA, 2449 bp, Homo sapiens
  Payload ID: 14038
  Gene Symbol: RAB35
  Gene Name: RAB35, member RAS oncogene family
  ENST ID: ENST00000544304
  CDS Start-End: 853-1296
attcagctcccaggctcggctcggagctggaccactccctcccctccaccaaagaggcaatgtgggctccaagaggtcacagcgctgggatgggatttcgaccccgcgctgccctcaaaggccacctcctcgcagctctgctcccgccggcagctcccgttctgtccaactcggaagccgcccgccgccctcggcgtccactccacaggcccggggccggggccagctccgcgggggaggggtcggtgcggaaggggcggggtaccgggccttccccgcgcgactctgccttctacggccccggcccctgcctctggaaacccggagctcgtgcgagccccgccccacggtcgcggcgtgcctgtcatttcctctccgcagggcgtgcgggtctcgaagatgagggagcaacaacgtccacgaccgggcttctccggcaccttgggcttctttccgctgggactcgacagcggctcggctccgcaagctctcagcgcccagggtggcggcgacgacgctccccgaggagacgcgaggaagacgggcccgcgcttgctgggactccgtcagggcgcgtgcgcgacccgggcgcggccggctcaggctgcggctgcgcaaggcggtgccagacgctgcgcctgcgcagtggtggggcggggcgggaaggagggaggcggtggtagcggcggcggctgctgaggaggaggagggggagcggagggaggtgtttctgtcagttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggggatttgggagcagcttgtcttacacaaggacgaaggaaaaggtcagggatcgagtggaagagatgttcttggtgtgtggccgctcagggaggtggaaagagcattgagaagtgtgggcaagagcagtttactgttgcgttttgcagacaacactttctcaggcagctacatcaccacgatcggagtggatttcaagatccggaccgtggagatcaacggggagaaggtgaagctgcagatctgggacacagcggggcaggagcgcttccgcaccatcacctccacgtattatcgggggacccacggggtcattgtggtttacgacgtcaccagtgccgagtcctttgtcaacgtcaagcggtggcttcacgaaatcaaccagaactgtgatgatgtgtgccgaatattagtgggtaataagaatgacgaccctgagcggaaggtggtggagacggaagatgcctacaaattcgccgggcagatgggcatccagttgttcgagaccagcgccaaggagaatgtcaacgtggaagagatgttcaactgcatcacggagctggtcctccgagcaaagaaagacaacctggcaaaacagcagcagcaacaacagaacgatgtggtgaagctcacgaagaacagtaaacgaaagaaacgctgctgctaatggcacccagtccactgcagagactgcactgcggtccctcccccagcccgaggcccacggaggttcctcgggggacagtctcagtttcgtgccgttatttaaagaattctctccatgtttttgtatcgggaggtgccatcggcacttcctcccccgccctcctcgagtgccaagaaggtgttggaccagcccgcccttccctactggtgccccctcctccccggccaaggcgcctggacctggcgaggacgctgcccgccgagcggactgattcgcagagtctgtacatagtgtatattgctctacccggccgcacaccacgtcctgctctggcttttgccttcttgatgccagcctgctgcaacagaccctccccgcgcccctccccagcccatcttactgcaagcagcgtcctgaggagacagcggcacgttctagctgcgtctgcggccagcccgtgccagtggagtgggctccgcgttgctcattctctccgacaggttgtcagcctctgtccccgctgcacagggtcttgccccttctccggggcctgtgccagctcccttccctccccgttgtcctgtccccacagccattctgggagctggggaacctggtctcaaggcaggccctgcagttccacagaggtggcaggtcttgccctttggccaacagatttcttgtcctgccttctagatgcctctgagctccaaacccagggcagccatggcttctcatttacaccaacaggtttcagttccaacagaaaggtcggggtaggttcgtgcagagatggggctggcaggggggctatgggaggattattttaacagatcaagaaaatgaagccaaatcaagtgaattaaattcctcacaatt

SEQ ID NO: 173187 - DNA, 643 bp, Homo sapiens
  Payload ID: 14038
  Gene Symbol: RAB35
  Gene Name: RAB35, member RAS oncogene family
  ENST ID: ENST00000538903
  CDS Start-End: 87-643
gccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgtgggcaagagcagtttactgttgcgttttgcagacaacactttctcaggcagctacatcaccacgatcggagtggatttcaagatccggaccgtggagatcaacggggagaaggtgaagctgcagatctgggacacagcggggcaggagcgcttccgcaccatcacctccactgccgagtcctttgtcaacgtcaagcggtggcttcacgaaatcaaccagaactgtgatgatgtgtgccgaatattagtgggtaataagaatgacgaccctgagcggaaggtggtggagacggaagatgcctacaaattcgccgggcagatgggcatccagttgttcgagaccagcgccaaggagaatgtcaacgtggaagagatgttcaactgcatcacggagctggtcctccgagcaaagaaagacaacctggcaaaacagcagcagcaacaacagaacgatgtggtgaagctcacgaagaacagtaaacgaaagaaacgctgctgcta

SEQ ID NO: 173188 - DNA, 3828 bp, Homo sapiens
  Payload ID: 14039
  Gene Symbol: RAB36
  Gene Name: RAB36, member RAS oncogene family
  Uniprot ID: O95755
  ENST ID: ENST00000263116
  CDS Start-End: 41-1042
ctgccagccccgcccagactccaggcaggttctcgttgctatggtgatcgccggtgcaagctggatgcttggacgcgccgctgccagtccaacgcagaccccgcccacgacgtcgacgattcgtgtagcccgcaggtcccgcgtggctctcgttgccatggtgatcgccgccgctggctcaggcggaccaggccgcgcggagccccagctttcacagccatcgctggactgtggaagaatgaggtcctccctgacacctttggggccccctgtgagccgcgaccgtgtcatcgccagcttccctaagtggtacacgccggaagcctgtttgcagctcagggagcacttccacgggcaggtcagcgctgcctgccaacgcaggaacacggggactgtcgggctcaaactctccaaggtggtggtggttggcgatctctacgtggggaagaccagcctcatccacaggttttgcaagaatgtttttgatcgagactacaaggccaccattggggtggactttgaaattgagcgctttgagattgctgggattccctatagcctccagatctgggacacagctgggcaggagaagttcaagtgcatcgcatctgcctactaccggggtgcccaggtgatcatcacggcctttgacctcactgacgtgcagaccctggagcataccaggcagtggttggaggatgctctgagggagaacgaggcaggctcctgcttcatcttcctcgtgggaaccaagaaggaccttctgtcaggggccgcatgtgagcaggccgaagcagacgctgtgcacctggccagggagatgcaggccgagtactggtcagtgtcggccaagactggcgagaacgtgaaggcattcttcagccgcgtagccgccctggcattcgagcagtcggtgctgcaggacctggagaggcagagcagtgcccggctccaggtcggcaatggagacctaatccaaatggaagggagtccgcccgagacccaggagagcaagaggccctccagcctgggctgctgctaactggggcctgcgtggaaggcctccgctccctgcacacacacggacaggaatttccgtgactgtggtgtggagactggagcccaagctctgcagcgtgtcgccctcaagctgtaggcccatgttccagtccctccacccacccaccgggctcagctccagggcacagtcacttgtccgttgcaggttgggcactagaaaaggcccccactggctgcctgggagccccacaccaccgggccagtgcaggcactgtggtgatcccataaaaggccagtccatttgcagggtcatcagacagtcacctttggcctcaagaggcctcagaactgcaaactcctgcgtcggtctatactactcggccatggcccacatcagcagtcaaccctgcactctttcccagcgatcttggatgtgtccccaggatccgtcacagtgttccaggcaacctggacttgtcaaagtcagcacctgaaggagaggccacctgccattccccctgggagttttctgttgtcagcaggacttatggttctgggtctcagagcttcaggcctcactgtccttctgccacggatgctcaaggttcctgggcagaccagcacctctggaggacaatggacaaaatgtctcttagacctgttctggctgaagggctatctctggcacctctgagatccctaggtcctgccctcctggtccgtgggccaggatgtgcagaacaaccactcaggcctttctggcccacctggacagtgcatttacctgtgtgctgcgggaggcagactgcacagctgtcctagggtaactcactctgcagcccttgaacatggcactgccctcctctggcactcatgctgggcctgtgcccactgctgcctctccatccctctctcattggcctatacatctcttaggacctttgtaatggtgtccatgcacctttagaggacttcagaggccctgccaagtctagcatgttcctgtctccaacaccgcctcctgcacatgcagagcagacagaaataccccacacattccccagcctctctgcccagtatgctcatccacagggttttctcactgctatgaaccagccccacagccccaggcccctgtcacctggctatgcccactcatcccacccgtctcgtgctgttgcttcccgtagatggcgagcaccttgcaggcagccttctgatcagtactgctctcctagggcctggcacactgcagctgccctgtaaatgttcagctcagcgattgccaaataccagttagggaagaacactggcatctttttctattcattcccccttcaacatattttttgtagttttttatataaatgacttttttttttttttgagatggagtttcacccttgttgcccaggctggagtgcaatggcgtaatctcggctcagtgcaacctctgcctcccaggttgaagcgattctcctgcctcagcctcccaagtagctgggattacaggcatgcaccaccatgcctggctaattttgtatttttagtagagatggggtttctccatgttggtcaggctgctctcggactcctgatctcaggtgacctgcccacctcggcctcccgaagtgctgggattacaagggtgagccaccatgcccggccataaatgattttattcatttttatgttttcttttgggcggcgggatggagtctctgtcacccaggctggcgtgcaatggcacgatcttggctcactgcaagcttccccttccgggttcatgccattctcctgcctcagcctcccgagtagctgggactacaggcacgtgtgaccatgccgggctaattttttatatttttagtagagagaggtttcaccgtgttagccaggatggtctcgatgatctgacctcgtgatctgcccgcctcggcctcccaaagtgctgggattacaggcctgagccaccgcgtccggcctccataaatgacttttaaaggggttgtatgtttagtgtgaacaaagacagtacaaagcatataaaatacaaggtgaaagccccccccccgccacattagctgcgcccctgaagtgtctccagcagaagagatggatgaatggaaggacacacagatggacagagagcaggaaagactgttagctctgctaacagtcaggactattccttctggactctgtgcctttgcctgcacagctagtgttgatggcttgtttgttgttttcaccagagtgagctccttctggacatactgcctggcagcctgccttcctagggagctggcgccaaggcctctccctgatggcacacaaggagcctccttcctgtagcagcgcccagttttcatgtggatggattgtagttcatttgaccctccccatccgcgggccatccggcttgtgtccagcttttagctcttgccaatggtgctgcagtggccattcttgtagttatagctttgcgtactcaggaaggcccttctcccgactgcggcccccagcctggtccactaaatgcagcctgtggtcgggcagacagcattggggtccattaggaagaccaggtttgctgggcataagcttcacaggacgggagaacctgcccatggtggactgtcgttctccacagctcccttcccttgccccttcgggcctccaggatatgtttgcgggggtgggtgtggtgtccagctgttaccagcttctgagctagagctgtactgcctcacgtacacccccacctctgtaaatggtccttgattaaatcgtcctcatattacctcc

SEQ ID NO: 173189 - DNA, 936 bp, Homo sapiens
  Payload ID: 14039
  Gene Symbol: RAB36
  Gene Name: RAB36, member RAS oncogene family
  Uniprot ID: O95755
  ENST ID: ENST00000341989
  CDS Start-End: 1-936
atggtgatcgccggtgcaagctggatgcttggacgcgccgctgccagtccaacgcagaccccgcccacgacgtcgacgattcgtgtagcccgcaggtcccgcgtggctctcgttgccatggtgatcgccgccgctggctcaggcggaccaggccgcgcggagccccagctttcacagccatcgctggactgtggaagaatgaggtcctccctgacacctttggggccccctgtgagccgcgaccgtgtcatcgccagcttccctaagtggtacacgccggaagcctgtttgcagctcagggagcacttccacgggcaggtcagcgctgcctgccaacgcaggaacacggggactgtcgggttttgcaagaatgtttttgatcgagactacaaggccaccattggggtggactttgaaattgagcgctttgagattgctgggattccctatagcctccagatctgggacacagctgggcaggagaagttcaagtgcatcgcatctgcctactaccggggtgcccaggtgatcatcacggcctttgacctcactgacgtgcagaccctggagcataccaggcagtggttggaggatgctctgagggagaacgaggcaggctcctgcttcatcttcctcgtgggaaccaagaaggaccttctgtcaggggccgcatgtgagcaggccgaagcagacgctgtgcacctggccagggagatgcaggccgagtactggtcagtgtcggccaagactggcgagaacgtgaaggcattcttcagccgcgtagccgccctggcattcgagcagtcggtgctgcaggacctggagaggcagagcagtgcccggctccaggtcggcaatggagacctaatccaaatggaagggagtccgcccgagacccaggagagcaagaggccctccagcctgggctgctgctaa

SEQ ID NO: 173190 - DNA, 554 bp, Homo sapiens
  Payload ID: 14039
  Gene Symbol: RAB36
  Gene Name: RAB36, member RAS oncogene family
  ENST ID: ENST00000420895
  CDS Start-End: 1-397
ggtcagcgctgcctgccaacgcaggaacacggggactgtcgggctcaaactctccaaggtggtggtggttggcgatctctacgtggggaagaccagcctcatccacaggttttgcaagaatgtttttgatcgagactacaaggccaccattggggtggactttgaaattgagcgctttgagattgctgggattccctatagcctccagatctgggacacagctgggcaggagaagttcaagtgcatcgcatctgcctactaccggggtgcccagggtgagcaacatgccacgtcggggctcaactgcatgcagcagcggggtccctgccgggctccacagtgggaatcccgagttctctgcacaggcaccagttttttgtcctccaagacccactgagaaaacaccaggccactgcttgggaacagggaagctgccttcatccccaggcactggctgactttggcgatcacaccctttaaggaccctgtggtagtgggtgctggctttaagtctcagccccagtttcagctcataaagatgctcagagatgaaa

SEQ ID NO: 173191 - DNA, 3804 bp, Homo sapiens
  Payload ID: 14040
  Gene Symbol: RAB37
  Gene Name: RAB37, member RAS oncogene family
  ENST ID: ENST00000340415
  CDS Start-End: 1010-1558
ttcatcccctgccaggagagcatagtagctcacatttattgagttcttagtacacgctgggcactgttctaggctttttacatgaattaactcattaaatactcagaacaaaaccatgaggcaggtactattataatattatctccattttgtggacacttaggaaagattaatttgcccgagtttgcacgactaataattttcagaatcgagatttgaatcctggagcctgtgctcctaaccaaaccaccatctgcctctcctgagcccattgtccttaacttcttgcggtcatgtgtgctggagagaatgtgatcaaagccctggaccttctccctaggaaaacgcaggtaaacagaattttgcatatttcagggactttggggacacctaagacccatctactgtcgacctcagacttagaagctctatttatctcatacatcctggagagaattgtccagggacaaaaacagaagcgccgccagcgccgcaggacttcgcctctgcaaacgtgtgaggagagctgcgctgcgctgagctgcgtggtgacggagatgcccgttcgctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactgtccagtgctgaaaacggatgcggcccggcccgcagagctcagacccaagcctgccgcacccagcggagctcgaaccgagctcctggaagcgctgacgcagagcgcagggagagccggagcggcgagctccaagcctggcatggacctgcagagacccgattcctaccagggaggagctggccctgacttcaacgaccacgtcctgcataagaccatcctggtgggtgacagtggtgtgggaaagacgtctctgctggttcagttcgatcagggcaagttcatccccggctccttctcggccactgtgggcatcggattcacgaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagc

SEQ ID NO: 173192 - DNA, 2858 bp, Homo sapiens
  Payload ID: 14040
  Gene Symbol: RAB37
  Gene Name: RAB37, member RAS oncogene family
  ENST ID: ENST00000392610
  CDS Start-End: 42-611
ttcgcctgcgggccggcactgctcacctctcgtccagggacatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggagaggggagggggcggctcagctcctcaccccagcccagcccagcccagcccagcccattgtctcttcttcaagggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 173193 - DNA, 2528 bp, Homo sapiens
  Payload ID: 14040
  Gene Symbol: RAB37
  Gene Name: RAB37, member RAS oncogene family
  Uniprot ID: Q96AX2
  ENST ID: ENST00000392612
  CDS Start-End: 44-604
ccttcgcctgcgggccggcactgctcacctctcgtccagggacatgacgggcacgccaggcgccgttgccacccgggatggcgaggcccccgagcgctccccgccctgcagtccgagctacgacctcacgggcaagaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 173194 - DNA, 2617 bp, Homo sapiens
  Payload ID: 14040
  Gene Symbol: RAB37
  Gene Name: RAB37, member RAS oncogene family
  Uniprot ID: Q96AX2
  ENST ID: ENST00000392613
  CDS Start-End: 57-728
gttcctgcgctctccttcgcctgcgggccggcactgctcacctctcgtccagggacatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgag

SEQ ID NO: 173195 - DNA, 2704 bp, Homo sapiens
  Payload ID: 14040
  Gene Symbol: RAB37
  Gene Name: RAB37, member RAS oncogene family
  Uniprot ID: Q96AX2
  ENST ID: ENST00000392614
  CDS Start-End: 94-780
gactacgggaactcttccgcagcagacggggtccccgcggcccgctcccccaggggcaagcaagcgaccacaggggaccggtcccggggctggatgtggctcatgtccgaagcgcacggagccgagccggtgttgctcagggaggctgcccgccccttcacgcagaccctgcggctctgcgtgccctcagggaacagcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 173196 - DNA, 2655 bp, Homo sapiens
  Payload ID: 14040
  Gene Symbol: RAB37
  Gene Name: RAB37, member RAS oncogene family
  ENST ID: ENST00000392615
  CDS Start-End: 191-766
ggaggcgcagcccaggggtccccagctccccgcctcgccacctggggacagcccacggcccggggctcgggcgccgcctgctgtcgcggtgcgcagcgactacgggaactcttccgcagcagacggggtccccgcggcccgctcccccaggggcaagcaagcgaccacaggggaccggtcccggggctggatgtggctcatgtccgaagcgcacggagccgagccggtgttgctcagggaggctgcccgccccttcacgcagaccctgcggctctgcgtgccctcagggaacagcaagaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgag

SEQ ID NO: 173197 - DNA, 1560 bp, Homo sapiens
  Payload ID: 14040
  Gene Symbol: RAB37
  Gene Name: RAB37, member RAS oncogene family
  Uniprot ID: Q96AX2
  ENST ID: ENST00000402449
  CDS Start-End: 447-1097
gttcgctcgggatcaggaacggtgagctcctgggaccgcaatgccctgagaacgcagccgggtgctgagcctccggagtccggtagctgaatgaaatacgcagggatcaccagccggacccaaatcttgcgtccctgccagcatcctggagtcctaagaggcagggattggagcggacaggatctcagaactctggtcccgggcgcacaacggcggagtcgctgttcctggtgctgaaacgctcagtcctggaagaacgtggccgcctgcccgcctggtaccgcgccgcggccgctgcggggaactgtccagtgctgaaaacggatgcggcccggcccgcagagctcagacccaagcctgccgcacccagcggagctcgaaccgagctcctggaagcgctgacgcagagcgcagggagagccggagcggcgagctccaagcctggcatggacctgcagagacccgattcctaccagggaggagctggccctgacttcaacgaccacgtcctgcataagaccatcctggtgggtgacagtggtgtgggaaagacgtctctgctggttcagttcgatcagggcaagttcatccccggctccttctcggccactgtgggcatcggattcacgaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtct

SEQ ID NO: 173198 - DNA, 1494 bp, Homo sapiens
  Payload ID: 14040
  Gene Symbol: RAB37
  Gene Name: RAB37, member RAS oncogene family
  ENST ID: ENST00000528438
  CDS Start-End: 123-713
aaagctctcccctggtgggacattctgggcacaaccaacaggccgggggaaatgagaggtgatccatactaaagggtcaaagtccccgcaccaggcagaggccccaaaacaccgcagcgtacatgtgctgcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacct

SEQ ID NO: 173199 - DNA, 1654 bp, Homo sapiens
  Payload ID: 14040
  Gene Symbol: RAB37
  Gene Name: RAB37, member RAS oncogene family
  Uniprot ID: Q96AX2
  ENST ID: ENST00000481224
  CDS Start-End: 3-674
acatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagca

SEQ ID NO: 173200 - DNA, 1653 bp, Homo sapiens
  Payload ID: 14040
  Gene Symbol: RAB37
  Gene Name: RAB37, member RAS oncogene family
  Uniprot ID: Q96AX2
  ENST ID: ENST00000613645
  CDS Start-End: 3-674
acatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctccgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagc

SEQ ID NO: 173201 - DNA, 1465 bp, Homo sapiens
  Payload ID: 14041
  Gene Symbol: RAB38
  Gene Name: RAB38, member RAS oncogene family
  Uniprot ID: P57729
  ENST ID: ENST00000243662
  CDS Start-End: 84-719
ttgcgctccccaagtctctctcgtgcgcagagcccaggctgcgcttccctggtcaggcacggcacgtctggccggccgccaggatgcaggccccgcacaaggagcacctgtacaagttgctggtgattggcgacctgggcgtggggaagaccagtatcatcaagcgctacgtgcaccagaacttctcttcgcactaccgggccacaatcggcgtggacttcgcgctcaaggtgctccactgggacccggagactgtggtgcgcctgcagctctgggatatcgcaggtcaagaaagatttggaaacatgacgagggtctattaccgagaagctatgggtgcatttattgtcttcgatgtcaccaggccagccacatttgaagcagtggcaaagtggaaaaatgatttggactccaagttaagtctccctaatggcaaaccggtttcagtggttttgttggccaacaaatgtgaccaggggaaggatgtgctcatgaacaatggcctcaagatggaccagttctgcaaggagcacggtttcgtaggatggtttgaaacatcagcaaaggaaaatataaacattgatgaagcctccagatgcctggtgaaacacatacttgcaaatgagtgtgacctaatggagtctattgagccggacgtcgtgaagccccatctcacatcaaccaaggttgccagctgctctggctgtgccaaatcctagtaggcacctttgctggtgtctggtaggaatgacctcattgttccacaaattgtgcctctatttttaccattttgggtaaacgtcaggatagagataccacatgtggcaagccaaagatctatgcctctgttttttcagtgagagagaaatagcaaatgttctttctatgctttcctcaccatcatcacagtgtttacaaacttttgaaaatatttagtctgttacaaacttctgtcatgtagctgaccaaaatcctgcagggccacagtcggcactgttatttgcttcttttaatcagcaaaggcctcaagtcttaaaataaaaggggagaagaacaaactagctgtcaagtcaaggactggctttcaccttgccctggtgtctttttccagatttcagtatattctctgatggcctgacaggcctattaagtagatgtgatattttctcccaagatgacctccattctcggcagacctaagagttgcctctgagttagctctttggaatcgtgaacacaggtgtgctatattgtccttgtcctaactgtcacttgccatggcctgaatgttggcttaactgaatattgtatgaaaagacatgcctccatatgtgcctttctgttagctttctctgactcaagctgtggggctcctctatacatgctatacatgtaatatatattatatatatttttgcaagtgaacaataaaacattaaaagatgctgtttccctatttatgaaa

SEQ ID NO: 173202 - DNA, 1007 bp, Homo sapiens
  Payload ID: 14041
  Gene Symbol: RAB38
  Gene Name: RAB38, member RAS oncogene family
  ENST ID: ENST00000526372
  CDS Start-End: 1-631
ccaggctgcgcttccctggtcaggcacggcacgtctggccggccgccaggatgcaggccccgcacaaggagcacctgtacaagttgctggtgattggcgacctgggcgtggggaagaccagtatcatcaagcgctacgtgcaccagaacttctcttcgcactaccgggccacaatcggcgtggacttcgcgctcaaggtcaagaaagatttggaaacatgacgagggtctattaccgagaagctatgggtgcatttattgtcttcgatgtcaccaggccagccacatttgaagcagtggcaaagtggaaaaatgatttggactccaagttaagtctccctaatggcaaaccggtttcagtggttttgttggccaacaaatgtgaccaggggaaggatgtgctcatgaacaatggcctcaagatggaccagttctgcaaggagcacggtttcgtaggatggtttgaaacatcagcaaaggaaaatataaacattgatgaagcctccagatgcctggtgaaacacatacttgcaaatgagtgtgacctaatggagtctattgagccggacgtcgtgaagccccatctcacatcaaccaaggttgccagctgctctggctgtgccaaatcctagtaggcacctttgctggtgtctggtaggaatgacctcattgttccacaaattgtgcctctatttttaccattttgggtaaacgtcaggatagagataccacatgtggcaagccaaagatctatgcctctgttttttcagtgagagagaaatagcaaatgttctttctatgctttcctcaccatcatcacagtgtttacaaacttttgaaaatatttagtctgttacaaacttctgtcatgtagctgaccaaaatcctgcagggccacagtcggcactgttatttgcttcttttaatcagcaaaggcctcaagtcttaaaataaaaggggagaagaacaaactagctgtcaagtcaaggactggctttcaccttgccc

SEQ ID NO: 173203 - DNA, 928 bp, Homo sapiens
  Payload ID: 14041
  Gene Symbol: RAB38
  Gene Name: RAB38, member RAS oncogene family
  ENST ID: ENST00000531138
  CDS Start-End: 1-268
caggctgcgcttccctggtcaggcacggcacgtctggccggccgccaggatgcaggccccgcacaaggagcacctgtacaagttgctggtgattggcgacctgggcgtggggaagaccagtatcatcaagcgctacgtgcaccagaacttctcttcgcactaccgggccacaatcggcgtggacttcgcgctcaaggtgctccactgggacccggagactgtggtgcgcctgcagctctgggatatcgcaggaaaatataaacattgatgaagcctccagatgcctggtgaaacacatacttgcaaatgagtgtgacctaatggagtctattgagccggacgtcgtgaagccccatctcacatcaaccaaggttgccagctgctctggctgtgccaaatcctagtaggcacctttgctggtgtctggtaggaatgacctcattgttccacaaattgtgcctctatttttaccattttgggtaaacgtcaggatagagataccacatgtggcaagccaaagatctatgcctctgttttttcagtgagagagaaatagcaaatgttctttctatgctttcctcaccatcatcacagtgtttacaaacttttgaaaatatttagtctgttacaaacttctgtcatgtagctgaccaaaatcctgcagggccacagtcggcactgttatttgcttcttttaatcagcaaaggcctcaagtcttaaaataaaaggggagaagaacaaactagctgtcaagtcaaggactggctttcaccttgccctggtgtctttttccagatttcagtatattctctgatggcctgacaggcctattaagtagatgtgatattttctcccaagatgacctccattctcggcagacctaagagttgcctctgagttagctctttggaatcgtgaacacaggtg

SEQ ID NO: 173204 - DNA, 1830 bp, Homo sapiens
  Payload ID: 14042
  Gene Symbol: RAB39A
  Gene Name: RAB39A, member RAS oncogene family
  Uniprot ID: Q14964
  ENST ID: ENST00000320578
  CDS Start-End: 67-720
acagttcccgccgccgaacttagcccgcgggtggggcggcccgggagccagcggggcacgtgagcgatggagaccatctggatctaccagttccgcctcatcgtgatcggggactccaccgtgggcaagtcctgcctcctgcaccgcttcacccagggccgcttccccgggctgcgctcccccgcctgcgaccccaccgtcggcgtggacttcttctcccgcctgctggagatcgagccgggcaagaggatcaagctacagctctgggacacggcgggacaggagcggttcagatcaataacccgatcttattaccgcaactcagttggtggatttttagtatttgacattactaaccgacgatcttttgaacatgtgaaagattggctagaagaagcaaaaatgtatgtacagccatttcggattgtatttctgctagtgggacataaatgtgatttagcttcacaacgtcaagttacaagggaagaagctgaaaaactgtcagcagactgtggaatgaagtatatagaaacctcagcaaaggatgctacaaatgttgaagaatccttcacaatcttgacgagagacatatatgaacttattaaaaagggagaaatttgtattcaggatggctgggaaggggttaaaagtggttttgttccaaatactgtgcattcttctgaggaagcagtaaagcccaggaaagaatgcttctgctgacttcaaacatgctgaagaactaacaggaacagattgggtgtcagttcaggataaataccaacattaacagcagaatgatgcaatgaaagaatttaaaaaggttacaaacccacaccaatactattttataaggtatttgattcagagcatgatgcttacttgttacactactagattgggtattttgctaaattaccaagcaaagcagacaatctttttcttgaaattacctccattcttactttgttagcatacgctgaccttagtgtccagatatgtcactattactcatttttcttgacagttcaaatggatttttgtgcatatatagtcaattgaaaagattttatcaggaattacattctcttgagttaattaatattgaatagcaaaatgcatttaaatatgcactgttcacctgcagagtaaacaatctcagaagtatcgactaggacgtaaatagcagttccttatataaagtaccaggttttttccccattctctggaaatgtttgtcctcccttaattttgcctcaacacaagaaaataagttttatgtccatttttgttccctaatttattgcttctaaaaatgcattatgttttacaaagatatctaaggatccaagcaaactactttaagcaaatatttgtaaaattaaaaacggaggaccgctcaccaaatgtttgaaatgttgctttttttttttgagacagggtcttgttttgtcacccaggctggagtgcagtggggcaatcttggctccctgcaacctctgcttcctgggttcaggtgattgtcagtaccttacctcagcctcctgagtagctggaactgcagatgtgcgccaccatgcccggctaatttttgtattataagtagacacagggtttcataatgttccccaggctggtctccaactcctcgcctcaagcaattcgcccccctcggcctccaaagtgctggaattataggcatgagctgccgtgcctggactatcagcagcacatgttttgctgttacggtgtactgttcgtatttagacaagaagaacaaaatttatttatgtattgacattttcaaagaaagtaaatgcaatttactttgaa

SEQ ID NO: 173205 - DNA, 3505 bp, Homo sapiens
  Payload ID: 14043
  Gene Symbol: RAB39B
  Gene Name: RAB39B, member RAS oncogene family
  Uniprot ID: Q96DA2
  ENST ID: ENST00000369454
  CDS Start-End: 302-943
ctcttacagatagtgcggcggcccaggcgtcgcgtctacgcgggggattacagtaacccggttgtcagtgatgagtcagagtgcgtggtgctgatgctgctgccatttcatcacctttgcgagcgcagcatccatccctccgctctcccggcgcctgggcctacccagcttcgggctcccaggccagcgatgcgctcgcggctgagctagatcctgccgagccgcgctctctgaggcgtcggcggggcgccccctcccgccgtccccggtccgggccaaggagacctgcagagccgcggccatggaggccatctggctgtaccagttccggctcattgtcatcggggattccacagtgggcaagtcctgcctgatccgccgcttcaccgagggtcgctttgcccaggtttctgaccccaccgtgggggtggattttttctcccgcttggtggagatcgagccaggaaaacgcatcaagctccagatctgggataccgcgggtcaagagaggttcagatccatcactcgcgcctactacaggaactcagtaggtggtcttctcttatttgacattaccaaccgcaggtccttccagaatgtccatgagtggttagaagagaccaaagtacacgttcagccctaccaaattgtatttgttctggtgggtcacaagtgtgacctggatacacagaggcaagtgactcgccacgaggccgagaaactggctgctgcatacggcatgaagtacattgaaacgtcagcccgagatgccattaatgtggagaaagccttcacagacctgacaagagacatatatgagctggttaaaaggggggagattacaatccaggagggctgggaaggggtgaagagtggatttgtaccaaatgtggttcactcttcagaagaggttgtcaaatcagagaggagatgtttgtgctagtcagttcttttatttccaaaacatgctctcctacttgaactgaaaagtaagagaaataaatagaatctttgtgtaactgatgagaactcaacctccatttggataccaagtgagcctccctctcagggggactctgacagactcgtgtgcgggtggatgggggtgcctgagtgctgtgaccaagggactgaattgctgacatgggccaggccaggcactgttttgtggcccatgctaggcagtggctgctccatgagccctttgtggaccacatgttaaaggcctggggtttaggaagctaagtcccaggaaaacatacctacagacaggacaactgttccttggtatttgagctcacttataggccatgaacataaagaaatacataaaggggaaaaaagtttcacaatggggacaattagcataactaaacaaagattatgagctctacttattccgtgagaataccctgcaccaaaggtgtttgctgggtttggttaaaaggtaccaattagcttttaacagctttctgtaaaatgaggaacacagaccaaaaggtctggtgttcaagtaaaaatgatgtgactatggaaaggaaggcaatcgacacagttattagcacatttcagaaaatgaacacccttgtgatagaattaccagctgtatgaaacaaattgtcccatgcaaattaccctataactaggaaagagacactataacccaaatgccataccccctttttcctttgaccatgcctggggtttcaatgccttggcacctgcaatctggaagtaaacagtctgcttgcttcttcaggcacgtgacagtgacaacacagtgactgcctctgaaaagagccctgaggcaaacactctctcctgctgaacaggaggcactgtaacccttacaaacagcttacagttacttgggctacttatttgatcatcataacaggcctacgaggtttttgccccattttacagaatagtaaactaagagccatgaaaatcacttggccagggtcaaggactcgtgactcctagctcttttcactgcatcatactgctgtcagatgaataaatgattatgaatttgtttacttgggaagagatatgactataaataaatgttctctacatgttaggatatgttttccttattgattacaactcagctataatcctgagggaacatgggaaggaatcaaaggtaaagcccattcaggcattattgacaagagggctttaaacaagtgaataattgcacaactaaaaagacattagaactgtgtgggctataagtgttcttatcactgagacacagtggatttttattgaaaggaaccacgtacagcaatgcggagtgggatagggataaaatacccaccccaaaatgaccttggccacctgtctgccatatacgtacactgagttcctgtctacccaagagagtcagcccttaattctcaggtgaacaaacagctaactgcatcagcaaattggaatggctggcttgaagtttccattattttcttgaagagaggtgatgctttaaattactttttggattgtagccagttcagctaggcaaaagccatacttttcacaattaaaaaaaaaaactattctgactagagtcaggtttctcatatccattgtgataggaaggcctaagaatggcaaatcgctttgagatataatattgaacttcagtatgaatgtgaccgaatctgaaactttgggaatttgctttagccagaataaagaaaccaaatcatgaaaattatggaagactattctgccacctgtgccccaagttggatgagcaaaccactttggatcagttcacagcattaactacaagtgaactgatcatcttctctatattcatttcacaagagctggcttaggtggggtaattaaattgccaccttcgtggttgtaaaagacaaacaaaacatggcaaatttcattaacacaaaatttcatcaactgctatactgaattatgtttagaagattctgaaagcaagattatccagtgggtaaatgagagtcgactggattctgtcagttcaaaaaaggaaagaaacaaaacttccctacaattttcttcactaaaatttattatatgtacagtattcccactcctggcattttctggcaggtttaaaaatattcagcataaatccagcagaggtggctgagcttaattgcttaaataagttctagaaaatttaaaaatcattttagtagaattcagtaccattgtcactgcaataagtgggttttagaaaataagtgtgaaaagaatcaggtgttaatataatactaaggataaagctttagaagctattttactacataggtaaagaaaagataaactaacttgtaacaaagaccacaactgcatgttggattagattgtctcatatttcagaataaaatgtactgtatacttttcctcactttgttgtgcactgtaatgaaatgtgaaaaatgctttatttagctgtatgtgaatgaaaatatgcttgtatttagtaaaatgattgattatgtga

SEQ ID NO: 173206 - DNA, 3690 bp, Homo sapiens
  Payload ID: 14044
  Gene Symbol: RAB3IP
  Gene Name: RAB3A interacting protein
  Uniprot ID: Q96QF0
  ENST ID: ENST00000247833
  CDS Start-End: 377-1759
gggccagggccgtgacacctgcgacgagccccgcctggcgccagggggcgcggaagcgcgtccgcccccaggccccatgccgggctcgccccgcccctgccggccacacccccctaccccgccctccctccgtgaggaccggccgctcccggctcccggcccccggccccgcttccggcgcaggcgcagtcccgcgttccctcggcggctgccggcgtagtgagcccgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagacatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccgtacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacata

SEQ ID NO: 173207 - DNA, 2055 bp, Homo sapiens
  Payload ID: 14044
  Gene Symbol: RAB3IP
  Gene Name: RAB3A interacting protein
  Uniprot ID: Q96QF0
  ENST ID: ENST00000362025
  CDS Start-End: 448-1683
ggttacctggcggcgggcgggcgcggccgggagcggagggccgcggtcgcgaagaggatgaagagagagttcccgaacaagtcggaagcagctcacaacaccggacgccgcgcggcagggctgtggacctggggtggtttcgtgtcccagtcttaggaaactacgcgcgaggcaccgtgctgaggcgtagaggtcaccctcgggaggtttcggtgaaacctggtgggaaattccgggcaggcgcccggagtcgcgcccaagtaggcagctccgtgccgccagacttgtgttcgggggagttgagacgaactgcacgggtgggattgcatggctctgccctcccagcgttgacaactcgccccgaccgcccaggaagcgcgagcttactggctccagaagtgatgatgctgggtggaagtcgcagcatgtgaagagttgccggttgttatgggattaaaaaagatgaaagggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattg

SEQ ID NO: 173208 - DNA, 2008 bp, Homo sapiens
  Payload ID: 14044
  Gene Symbol: RAB3IP
  Gene Name: RAB3A interacting protein
  ENST ID: ENST00000378809
  CDS Start-End: 448-1557
ggttacctggcggcgggcgggcgcggccgggagcggagggccgcggtcgcgaagaggatgaagagagagttcccgaacaagtcggaagcagctcacaacaccggacgccgcgcggcagggctgtggacctggggtggtttcgtgtcccagtcttaggaaactacgcgcgaggcaccgtgctgaggcgtagaggtcaccctcgggaggtttcggtgaaacctggtgggaaattccgggcaggcgcccggagtcgcgcccaagtaggcagctccgtgccgccagacttgtgttcgggggagttgagacgaactgcacgggtgggattgcatggctctgccctcccagcgttgacaactcgccccgaccgcccaggaagcgcgagcttactggctccagaagtgatgatgctgggtggaagtcgcagcatgtgaagagttgccggttgttatgggattaaaaaagatgaaagggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaattggcttcagctgttctggaggctgtggaaaacaatactctaagcattgaaccagtgggattacaacctatccggtttgtgaaagcttctgcagttgaatgcggaggaccaaaatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagtt

SEQ ID NO: 173209 - DNA, 2386 bp, Homo sapiens
  Payload ID: 14044
  Gene Symbol: RAB3IP
  Gene Name: RAB3A interacting protein
  Uniprot ID: Q96QF0
  ENST ID: ENST00000378815
  CDS Start-End: 196-1143
aggcgcagtcccgcgttccctcggcggctgccggcgtagtgagcccgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggtaactcatcaaggactgtcccctctgactctgttgatacttgttagttctcatcactgaggtgtcagttatcatttttgccagcaaaatttttagtacaaaataatgcagtattaagatgggggaggctttatctagagctggctgctttcagggattcttcagttccattttctacctggctgaccttggagtacctgctggaaacttggtaagtttcttaatctcagtatttcattaagggaggaaactgtcatgtgttgtctagaggagagtgggtggctttaatgatctggctagtcaaaatttattgctagagtgcgcttacaaagtatggatataagaaatatgtgaaaataagatgattttcttaaagatcaatacattgcttttatttaaattcagagagaattttatgtcagcaagggagtcctagagttaatttagataattaagcaacaaaaaaatagaaataatggtagccttacaatgacataaggctggaagacattttgctaagtgaaatttcaagttatagtagaacaattagtgtcatttttgatcccaaattaggtttcacagttcagccagtctgttattcagacacttacaactatgtaaggccaccattatcatgtatccataacaattaaaaatttaaaaacgaaataatgggccgggcatggtggctcatgcctgtaatctcagcactttgggaggccaaggccggaggatcacctgaggttgggagttcgagaccagcctgaccaacatggagaaaccctatctgtactaaaaatataaaattagctgggcatggtatctcatgcttataatcccagctactcaggaggctgaggcaggagaatcccttgaacctgggaggcggaggttgcggtcagctgagattgcgccatcacactccagcctgggcaacaagagcgaaactctgtctcaaaatcataataataataatagtcttattttaaaagatatgttacaaagataactgaaataatatataaatattttgagctgtttagagtaaaaatttttaatcattgtatactgtgagaatgcatttctaagaggattgatcaataatttatgaagctttcccatttcttcttagaagccatcttttacattgttaaattcaagtccatcattaatcttgaagaaatgtgtgtgcttgttaaatttttgtatggaagccaggagtttattaaatggaataaccaatgttaacctgttttaattgaattgcattttgacgaattatcaataaaaatgatgctggtaa

SEQ ID NO: 173210 - DNA, 1755 bp, Homo sapiens
  Payload ID: 14044
  Gene Symbol: RAB3IP
  Gene Name: RAB3A interacting protein
  Uniprot ID: Q96QF0
  ENST ID: ENST00000483530
  CDS Start-End: 196-1383
aggcgcagtcccgcgttccctcggcggctgccggcgtagtgagcccgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattg

SEQ ID NO: 173211 - DNA, 943 bp, Homo sapiens
  Payload ID: 14044
  Gene Symbol: RAB3IP
  Gene Name: RAB3A interacting protein
  ENST ID: ENST00000526994
  CDS Start-End: 1-569
gaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacagggtaagtgacttaaccatgaattttaataaagcttgctttgatatgggacatttgaccattcatgacattttctccatttggcctagatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattgaa

SEQ ID NO: 173212 - DNA, 1613 bp, Homo sapiens
  Payload ID: 14044
  Gene Symbol: RAB3IP
  Gene Name: RAB3A interacting protein
  Uniprot ID: Q96QF0
  ENST ID: ENST00000417413
  CDS Start-End: 196-1110
aggcgcagtcccgcgttccctcggcggctgccggcgtagtgagcccgccgccgtggagtgtagcggaaagggctcgccgtcctcctccgtttctcgctgcttcgggacgcgctctctgcggctctgtgagcgcccctgagcgccggcagcggccgcggtgggttcttcaggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagagaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattg

SEQ ID NO: 173213 - DNA, 9646 bp, Homo sapiens
  Payload ID: 14044
  Gene Symbol: RAB3IP
  Gene Name: RAB3A interacting protein
  Uniprot ID: Q96QF0
  ENST ID: ENST00000550536
  CDS Start-End: 458-1888
gagtccagcgggttacctggcggcgggcgggcgcggccgggagcggagggccgcggtcgcgaagaggatgaagagagagttcccgaacaagtcggaagcagctcacaacaccggacgccgcgcggcagggctgtggacctggggtggtttcgtgtcccagtcttaggaaactacgcgcgaggcaccgtgctgaggcgtagaggtcaccctcgggaggtttcggtgaaacctggtgggaaattccgggcaggcgcccggagtcgcgcccaagtaggcagctccgtgccgccagacttgtgttcgggggagttgagacgaactgcacgggtgggattgcatggctctgccctcccagcgttgacaactcgccccgaccgcccaggaagcgcgagcttactggctccagaagtgatgatgctgggtggaagtcgcagcatgtgaagagttgccggttgttatgggattaaaaaagatgaaagggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagacatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccgtacaaactaaaatcacttttggagaaagtacctaaataaaaagagaaacaaatccaggagatactgtacggtttgaaagaaaggtaatcaaatactcagaaaaagtttgttgatgacttaaaaaggataaataaaaagtaagactaaagaaaatcagtatacccattaataataaatctttagtaatctataaggggaagaatgcttttcaaccttatacactagaagcatgctctttaaaattaatgcaacaggatgacgacttgatgtagaaactatatgtggaattatagattaaaatgtgattgaaacatatttagaaaatgtgattatcttcctgatcctactccctttaggaagaacttcttaaactggaagcaggaaaaaaaaaaaccataaaagataaccataaaagaatataagttatggtatattataaattcttaatttagaaatcgtgcatcagtagttaggcattgtggctcatgcctgtaatcccagcactttgggaggcagaggcagaaggattacttgagctgcttgagcccaggagtttgagacgggcctgggaaaaatagggaaactccatttacacacacacacacacacacacacacacacacactgtgtccatgaacttgggaggatgaggtgggaggattgcttgagcccaggggttcaagtccaacttgggcaacatagggagaccttgtctctaaaaaaaaaactaaagctaaactacaaactgtgaggcaatatctgcaacatttataactagtaatagcttagtatcaagaatgtatgcagaaattctacaaaccaacaaaaaaggacagtgtcacagaaaaacaggcaaaagactgaaccaggccttccacacaattagaagtgcatgtgggccaataaacattaagaggttttcatctctcaatcaggaaaacgtaaatcaagatgacaatgacatgttcaaattcattcgattggtgaaaatgaagaaacacaaagtcaagttttggagagggttttagtcattaggatcactcacatattgctgatgggggtatcaattggtatatccactgtgaaaaaccattcactagaaaagttgggccaggcccagtggctcatgcctcttggctttgggaggccaaggtaggaggatcacttgagcccaagagttcaagaccagcttgagcaacatagggagaccacatctgcacaaaaagatttttttgaattagctgggcatggtggtgcatgcctgtggtcccagctacttgggaagctgaggtggaaggattgcttaagcccaggaggttgaggctgcagtgaatcatgattgtgccactgcactcttaccttgggtgacagagtaagatcataccttaaaaaaaaaaaaaaagtatacccatgggtcagcaatttcacttttcagtatatacttgagaaatgcttgcacaggtcccccagatcacacatataagaatgttctggaataaattaaaatgtctatttttaggaaggtgtaatgtgttcacagaatgggtgattattacatggcagcaaaatgaatgaataccagctacttgcagcacaataactcagaatgaaaaagcaattctgagaaaactatatgtgacatgatacttttcttataaaagtcaagaacaactaaaactgaacagctgtttaggcattgacatatgtgacaaaacttttaaaaagtaataaagttcaagatagtggttacctctggagaggtagaggaggagcaaatctatgagtaagtcactggtaatgttttagtccctgggttaggtggtgggttttggggtggttcatttgtcattaaaagtaagtacatgagctgggtgtagtggtgcgtgcttatagtcccagctacttgggagtctgagataggaagatccttgaggccagttcaaggctatagtgtgctatgatttcacctgtgaatagctactatattccaacctgggcaacgtagaccttgcccccctttaaaaaaattcaaaaacaaaataaatgcatggacaaatgaataagagagttatgcatggaacatcggtggtgtattatgaatcaagcattattactagctcagttatatgtgccttcattccaaaacaaaaaataaaaggtaagaaaattgttgaattgcatttgagagagaggaaaggaaagaattcaggtctgaatcttaggcttttggcttgagctattgcagtttattgagatggggaaatacatggtggggaaagtttgggtatgtgcataacagagacagaaattcagtgtttgacagatcaagtgtgaggtgcccactgagcatcaaagtggatatgttaagcaggtattggatgtacaaatctaaattcagtaaggtcagtccaggagaaaatttggggagtagttagccatgggatcagatgggcgctttagggacactttggagatgaagtacagcactgagccctgagttcctgtgacagagaagcagcctgcaaagacgaaaggaggagctgttaggaagagcaaggcaacagaaaaggaagaaccagcatgctgattatgttcaggagagtgtttctacgctgaatttaattgccaagattaccaattctaaagaagaggaggactcttggacaagtttttagaagttggtttggagctggggtgagagcctggcctaatggagacagctctggattgggagtcacttagacctacattctggtctaggtttggctcccaaaaactgggaaggttagttaggtggccactcctctctcttcatggtctctctcagcttgaagacaatttacagtctttgactaagcatccacactggaagaacaagatttggtttctgaacattgggtcttagtccttaaaataacttgcaacctgttacgtcttcacttactcccatcgccaccacaagaatcctgtgtgtttttgttttgtgcatccagtctaaaacgggtctgcttttattcataggcttttgttttcagtggtttttgttgttgcatttttccctagataaaatgttttttctataagacactgcttaaaagagtccaatgcagtatgaatttgtatttgtgtttaacttttgtgcttaacagatctgccatggctgaactctcagttgcttaagcaaaattctggggcttattctaggttcctttatttgtcattgtcactcccattccagttatcagcaaattccatcagctgtctccgagacatcttaaatctgtctacctccctccatgtccactgctaccactctgcccaagctattatcatctttcacctgaactcctgcactaatgtctgctgtccttgcatccactcctgccctcctacaatcactgacggcagccgcagggatctttataaaacgaaaatcagataatgtcacttccctgcttaaagccctttgagtggcttcccattgcacttagaaaaaaaaaaaaaaaaaaaaactggccaggtgcgatggctcatgcctgtaatcccagcactttgggaggccgaggcgggcggatcccctgaggttggtagttcgagacctgcttggccaacatggagaaaccctgtctctactaaaaacacaaaattagtcaggtgtgatggcgcatgcctgtaatcccagctacttgggaggctgagtcaggagaaacgctcgaacccaggaggcagaggttgtggtgagttgacatcacgccattgcactccagcctgggcaacaagagtgaaactccgtctgaaaaaaaaaaaaaaaaacccaaactcaatagaaaatcaagttttcatagtggtagttgttaacagagaaataacaatgaaagctttaaaaaactccatgaaaatttgcaaaacttaaaaaaaaaatgtagaagaggactaaacttgataaaatattaaaagaattgaaacccttcctaaaggcagcttctcaagggagcacaagttcacacacagtttacttttggaggaacgtctgaggtcatgaggactagattctagagctacaggtctcagggacagtctcgagggatacagggcccccatcaccacatccccagatttaaccgcagcagctcagcttttatctgtatctgttggagctctctaggaaatgtcaataccaaagcaaacccaaatcacaactagattagattactattcaagagaatgattctctaccgaaactctgcaaaatggggatatcaagagagttggaaaatgtaagacgtaaagaccataatcaggaaaatacgcatcatatttgttattcactgagagggaggaatttccacttaaatcctatttccagcagctggattgtgctctcagtggagtgctctggattctgattaatagagattttctagtcctcccagcaacttccttctcaattctcttcactttccgcagatctcggcaccagggttgcatcttgtgggctccattgtgttttcacacaatgtgctatttgtccttcacagtgttttggtttatttttctgtttgtccatcttgtttttgaacaattgccagcatttaaaaatgaggaaatctaaaatctgcatttcaagctgctcttttttaaaatgtgccgtttcgacaacactgagcccacagtcttgaatgacaacacttgggtggagctgagtgactccacctgtcgggtggctacacccttgctcagggtatgcactccatggtttgctctatggcccaccatcctggattgtctccctgacaccaaggctaagggacccactttactcacttatctgctgggccttggaagtatttcagttcggaaccccaattctaaccttagcttctcaggccattaaatgaaatctcatttctatgatgcttcctgtcacatcactgtgctgctgagaacatgaagtctgtgggtgaattggtggacgggatccagaatcattacttggcagtggattatagtgtgatgactcatttccggtggtctccaggagacttggctgggagcttctcttggagtctagggttagccagaggctacatgttttaggcatcttaattcatattttatctaaaggcatataaatccttaaaaaaaatcatttgacttcatccttgctccctacatccagccagtaaccattgctttgttttacatcgcgtgcttcaggctttactacagcctacctggattttgcagtagcttcttaaactgcttaaactttggatattgccccagccaacacattctgccacagagatctctctgagttaaatgggattgtatcatgccccacacccaagcagatagaaactgtcaatagatacacttagaatgaatatgcatggaatcaaattacattcagaatctaccactataggtagtgaatacaacaggatagcagaggctgggaagggtaatgggggttggggggtgggaggataaaggggttgggtaatgggtgtaaaaatctatagaaggaatatgatctgttgtttggtagcacaatagggtaaatacagttaataatttattgtatatttcacaataaaggagtggatttggaatgttctcaacacaaatgataaatgtttgaggtgatggataccccaattaccctgatttgatcattatacgttgtatgtttgtatcaaaatatcatatgtaccccataaatatgtacaactattatgtatccataaaaattggaaataaactaccaccatctttcttcagcctattttcctatctcctctcgcaccatactaggcacacaatctctgtacctgtgctgtcttccaagccattgctcatgttttaagaaatatacttattgtttaatatatcctgtaccactgtaggatgactgtagttaacaataatgtgtagtttcaaatagctaatagctggaaggaagttgttgaatgtttccaacataaagaaatgataagtgtttgagatgatggatatgctaattaccctgatctgatcactacacattatatgtatggaaatatcattgtgtaccccatgaatatgggcaattattatttgttaattaaaaaaataaaaaaaagacccacccactgtttaa

SEQ ID NO: 173214 - DNA, 695 bp, Homo sapiens
  Payload ID: 14044
  Gene Symbol: RAB3IP
  Gene Name: RAB3A interacting protein
  ENST ID: ENST00000547591
  CDS Start-End: 1-64
aggttatcttatgatgaggcttttgctatggctaatgatcccttggaaggcttccatgaagtaaaccttgcttcacctacttctccggaccttcttggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcagg

SEQ ID NO: 173215 - DNA, 2674 bp, Homo sapiens
  Payload ID: 14044
  Gene Symbol: RAB3IP
  Gene Name: RAB3A interacting protein
  Uniprot ID: Q96QF0
  ENST ID: ENST00000553099
  CDS Start-End: 239-1003
tgtttacctaagcaagcctgggcaatggcgggcgtccctcccccagcctcgttgccgccttgcagtttgatctcagactgctgtgctagcaatcagcgagattccgtgggcgtaggaccctctgagccaggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagacatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccgtacaaactaaaatcacttttggagaaagtacctaaataaaaagagaaacaaatcc

SEQ ID NO: 173216 - DNA, 670 bp, Homo sapiens
  Payload ID: 14044
  Gene Symbol: RAB3IP
  Gene Name: RAB3A interacting protein
  ENST ID: ENST00000550847
  CDS Start-End: 63-566
aatggaataaccaatgttaacctgttttaattgaattgcattttgacgaattatcaataaaaatgatgctggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttt

SEQ ID NO: 173217 - DNA, 742 bp, Homo sapiens
  Payload ID: 14044
  Gene Symbol: RAB3IP
  Gene Name: RAB3A interacting protein
  ENST ID: ENST00000550647
  CDS Start-End: 1-712
ctataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagaaaatgtgctctcactggccagagtaagtcctgtaaacacagaattaaattagggga

SEQ ID NO: 173218 - DNA, 438 bp, Homo sapiens
  Payload ID: 14044
  Gene Symbol: RAB3IP
  Gene Name: RAB3A interacting protein
  ENST ID: ENST00000547055
  CDS Start-End: 1-276
ataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggttggtctatttacatcttggccaacagcaacatcttgacttttatatattgacaaaattgtattttgagggaatcttgaaaaatatttgcttagcttcatgtatatttataagtcctctaagcaaaagagaaatctttaagcaatgtagagtttacaacttaagatgatgtgaaaagaaataaaaaacatctatgggcca

SEQ ID NO: 173219 - DNA, 2840 bp, Homo sapiens
  Payload ID: 14044
  Gene Symbol: RAB3IP
  Gene Name: RAB3A interacting protein
  Uniprot ID: Q96QF0
  ENST ID: ENST00000551641
  CDS Start-End: 341-1105
gagcttcccggctgctttgtttacctaagcaagcctgggcaatggcgggcgtccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcggatgggagtgacccgattttccaggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagaggctgacttatccttgtataatgaattccgattgtggaaggatgagcccacaatggacaggacgtgtcctttcttagacaaaatctaccaggaagatatctttccatgtttaacattctcaaaaagtgagttggcttcagctgttctggaggctgtggaaaacaatactctaagcattgaaccagtgggattacaacctatccggtttgtgaaagcttctgcagttgaatgcggaggaccaaaaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattgaatgtgtgtacattttctcttctagctctgacatggcatttagggttagcagaatgtattaaatagtaattttcaaactacacagtagcttccttccttgtgagaggcaagaaagaagtctgagtggatagtactcactttccaaggcccccacctctagaatggctttatttttatctgttttctatattgggtttcaaaaaagattttatttgaagaaatacttctgctgctacaaagtttgaaagttactattttaattattctgctctctgtaactgaaagaatccctttattttggttattcattaaaatataatagaaggcagtcagattttatcccagagatgtattcctgagtgtcttgatatagtgtattcatgttttatatgtgttgaccactatattgtcattggagggacatagatgtaaatgagtttgacgtgtgtcaaaggggtttaaaggggtgtggattgaatgaatggtacgtgcgaagtatatgctgattatagaaccacttgatctctgcattccaaattgtaaaactgactcaactggagaaattataacaaagaggtttgtggtagacatgtaataagtatagaaaagcaaaaagaaaagagaaactgctttagtttctgtttagagaaagctgctgttaatatttttggatagtagcctttcagctttcagatattttctacttacatatgcatatttttgaaacaaaaagtaggctttttttttgctttttaaacctaaacattaaatatattttcccttgggtaaacctacacatcctaatccctgtttatagaattttaacataatttaattgtgtttggagatgaggtggttttcagtttatttttcatattataatgctgtgacgagtatccttatctgtacacttctgaacattgtggagttctttcatgtggatgcctggagataaaattgtgtcgagatatatatgtatttttaaatgtttgatctgcattgctagattgccatccagaaaagttaatcaatttgtattcacagcagcagtgtacaagagggctggttttctgaagataacatttttttcagtcctgttcagaggtttggtcaatcttacctgtagatgacttcagccaccaggctggatgggagcccacagacaaaaggacattggtgtatgttatggtgaaaaccatcagtaccatgcctagctcaagaatgtgaaattgaacctgaaaaaaactttgaacctacaattttatgttctgaaaatagttattctaatgtgagggcattaataagaatatgtaccatcaaagcttcagaagattttccgtacaaactaaaatcacttttggagaaagtacctaaataaaaagagaaacaaatccaggagatactgtacggtttgaaagaaaggtaatcaaatactcagaaaaagtttgttgatgactt

SEQ ID NO: 173220 - DNA, 1905 bp, Homo sapiens
  Payload ID: 14044
  Gene Symbol: RAB3IP
  Gene Name: RAB3A interacting protein
  Uniprot ID: Q96QF0
  ENST ID: ENST00000552199
  CDS Start-End: 440-1402
ggcggcgggcgggcgcggccgggagcggagggccgcggtcgcgaagaggatgaagagagagttcccgaacaagtcggaagcagctcacaacaccggacgccgcgcggcagggctgtggacctggggtggtttcgtgtcccagtcttaggaaactacgcgcgaggcaccgtgctgaggcgtagaggtcaccctcgggaggtttcggtgaaacctggtgggaaattccgggcaggcgcccggagtcgcgcccaagtaggcagctccgtgccgccagacttgtgttcgggggagttgagacgaactgcacgggtgggattgcatggctctgccctcccagcgttgacaactcgccccgaccgcccaggaagcgcgagcttactggctccagaagtgatgatgctgggtggaagtcgcagcatgtgaagagttgccggttgttatgggattaaaaaagatgaaagggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgcaaaagctcagagggaactgaagttaaaagatgaagaatgtgagaggctttcaaaagtgcgagatcaacttggacaggaattggaagaactcacagctagtctatttgaggaagctcataaaatggtgagagaagcaaatatcaagcaggcaacagcagaaaaacagctaaaagaagcacaaggaaaaattgatgtacttcaagctgaagtagctgcattgaagacacttgtattgtccagttctccaacatcacctacgcaggagcctttgccaggtggaaagacaccttttaaaaaggggcatacaagaaataaaagcacaagcagtgctatgagtggcagtcatcaggacctcagtgtgatacagccaattgtaaaagactgcaaagagaaaatgtgctctcactggccagagtaagtcctgtaaacacagaattaaattaggggactcaagcaactattattatatttctcctttttgcagatacaggatcacttctgtatgtaacttttttacatacattcgatacattcagcagggactcgtgaaacagcaggatgttgatcagatgttttgggaggttatgcagttgagaaaagagatgtcattggcaaagctgggttatttcaaagaggaactctgatgctctgcgtgggaccatgcctgaactccccgaataactgaaaaatggctgaatatttttatggttacttgatatttatttccaaggagtgagcctaagacttttttccccttttgcaaattgctctaagaagtaccatgatttcttttaaactgatctatgctgtgtttgcttattctttagttgaacacactatgaagaattccaggtgtactagtgaatgtaatttatagttgccaaaaaaaaaaaaaacctgaaataaataaatgttagattg

SEQ ID NO: 173221 - DNA, 580 bp, Homo sapiens
  Payload ID: 14044
  Gene Symbol: RAB3IP
  Gene Name: RAB3A interacting protein
  ENST ID: ENST00000549760
  CDS Start-End: 84-580
gagtcggccaggaggggcggccgcggcaggtgcaggtgctggcgccgtgcagggcgcggttatcttatgatgaggcttttgctatggctaatgatcccttggaaggcttccatgaagtaaaccttgcttcacctacttctccggaccttcttggtgtgtatgaatcaggaactcaagagcagactacctcaccaagtgtcatctaccggccacacccttcagctttatcctctgtacctatccaggcaaatgcattagatgtttctgaacttcctacacaacccgtgtattcatcccccagacgtttaaattgtgcggaaatatctagtatcagctttcatgttacagacccagccccttgctctacctctggagtcacagctggattaactaaattaactacaagaaaggacaactataatgcagagagagagtttttacagggtgctactataacagaggcttgcgatggcagtgatgatatttttgggttgagtactgatagtctgtctcgtttacgaagcccatctgttttggaagttagagaaaagggctatgaacgattaaaagaagaactcgc

SEQ ID NO: 173222 - DNA, 2125 bp, Homo sapiens
  Payload ID: 14045
  Gene Symbol: RAB3IL1
  Gene Name: RAB3A interacting protein (rabin3)-like 1
  Uniprot ID: Q8TBN0
  ENST ID: ENST00000301773
  CDS Start-End: 78-1148
ctggtggggggaagaaggctcctgctacctcccttcccggcaccctccagagggaccctcagtctggccttgcaagcatggactcttctgaggagcacgctgggtgccccgcccgagggacatgtcccgtgttcctggccatgagtgcagggactgtccgctacgccccatcaggcctgtgccctgtacttgaggggaacttgagagaagagccctggggcacagacagcccaccccagccagaccagggcctcccgccgccccttgcagctgtcccggtcccctggaagagcacggacccctgccaaggccacagggagtccccaggagccctggtggagacctctgcaggggaggaggcccaaggccaggagggccccgcagccgcccagctggacgtgttgcgcctgcgcagctcttccatggagatccgagagaagggctccgagttcctgaaggaggagctgcacagagcgcagaaggagctgaagctaaaggacgaggaatgtgagcggctgtccaaggtgcgggagcagctagaacaggagctggaagagctgacggccagcctgtttgaggaagctcacaagatggttcgagaagccaacatgaagcaggcggcatcagaaaagcagctgaaggaggctcggggcaaggtggacacaatcctgtttgcagagttccaggcctggagggaatcccccaccctggacaagacctgccccttcctggaaagggtgtaccgagaggacgtgggcccctgcctggacttcacaatgcaggagctctcggtgctggtacgggccgccgtggaggacaacacgctcaccattgagccggtggcttcgcagacgctgcccacagtgaaggtggccgaggttgactgtagcagcaccaacacatgtgccctgagcgggctgacccgcacctgccgccaccgaatccggctcggggactccaaaagccattactacatctcgccatcttcccgggccaggatcaccgcagtgtgcaacttcttcacctacatccgctacatccagcaaggcctggtgcggcaggacgcagagcccatgttctgggagatcatgaggttgcggaaggagatgtcactggccaagctcggcttcttcccccaggaggcttagggcgcggcccaggcctgaaggggagctctgagacagagcaaacacccaccccagaacaagccgacacacagggagacgggggcctggagccagccctgagccagaggcagaatggatggacagacaggccatggaggcagcactgagccagcaccacacgtccatcctgggacagacgggcctggacttcacggcaagacccccctctcttccccactgggttctgccaccaccaggaggatttcaagaaagcaccaaagaccagggagctcggatccatactcggggggcctcagcccttgggaggggacacctgaggcagccagcgccccctccccagtccccagaactgcctgcaggtgccttgttgctggcttgtcttcagaaagggactgttctgggtggctggatctccagggtaccctccaccccagctgccaagccctgggccagcagcacccccttgtggccatcctgtgccttgttcccggtggcctccctattggactactaggaggggctggcagggcctccatagcacagaattgccccaaagccttgttaagatgagtcaagacccctcccccgcttcctcccttcctttcccccttcctccctcccccttcataaaggcctcccttgtcaccttccctcccaccccgtctcagccctgtgctcctggaggccctgctcccaaaaccgctggaaggactggggcactttctgccacagtagaacacagacagggcttcagatcacccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaaggcaggctttgttggta

SEQ ID NO: 173223 - DNA, 2284 bp, Homo sapiens
  Payload ID: 14045
  Gene Symbol: RAB3IL1
  Gene Name: RAB3A interacting protein (rabin3)-like 1
  Uniprot ID: Q8TBN0
  ENST ID: ENST00000394836
  CDS Start-End: 159-1307
cgagcccaggcgtctgagacctactgaccggccgcgggcagggctgacaggcggtggggcggctcggcccctggcggagtcggcggcgggcggggacgcggcgctgggaggacgcggcggcgctgggaacggacgcctgggcgccccgaggcgccgggatgtggagcggcccaccccagccagaccagggcctcccgccgccccttgcagctgtcccggtcccctggaagagcacggacccctgccaaggccacagggagtccccaggagccctggtggagacctctgcaggggaggaggcccaaggccaggagggccccgcagccgcccagctggacgtgttgcgcctgcgcagctcttccatggagatccgagagaagggctccgagttcctgaaggaggagctgcacagagcgcagaaggagctgaagctaaaggacgaggaatgtgagcggctgtccaaggtgcgggagcagctagaacaggagctggaagagctgacggccagcctgtttgaggaagctcacaagatggttcgagaagccaacatgaagcaggcggcatcagaaaagcagctgaaggaggctcggggcaagatcgacatgctgcaggcagaggtgacagccttgaagacgctggtcatcacgtccacaccagcctctcccaaccgcgagcttcacccccagctgctgagccccaccaaggccgggccccgaaagggccactctcgccacaagagcaccagcagcaccctctgccccgccgtgtgtcccgctgcgggacacaccctcaccccagacagagagggcaaggaggtggacacaatcctgtttgcagagttccaggcctggagggaatcccccaccctggacaagacctgccccttcctggaaagggtgtaccgagaggacgtgggcccctgcctggacttcacaatgcaggagctctcggtgctggtacgggccgccgtggaggacaacacgctcaccattgagccggtggcttcgcagacgctgcccacagtgaaggtggccgaggttgactgtagcagcaccaacacatgtgccctgagcgggctgacccgcacctgccgccaccgaatccggctcggggactccaaaagccattactacatctcgccatcttcccgggccaggatcaccgcagtgtgcaacttcttcacctacatccgctacatccagcaaggcctggtgcggcaggacgcagagcccatgttctgggagatcatgaggttgcggaaggagatgtcactggccaagctcggcttcttcccccaggaggcttagggcgcggcccaggcctgaaggggagctctgagacagagcaaacacccaccccagaacaagccgacacacagggagacgggggcctggagccagccctgagccagaggcagaatggatggacagacaggccatggaggcagcactgagccagcaccacacgtccatcctgggacagacgggcctggacttcacggcaagacccccctctcttccccactgggttctgccaccaccaggaggatttcaagaaagcaccaaagaccagggagctcggatccatactcggggggcctcagcccttgggaggggacacctgaggcagccagcgccccctccccagtccccagaactgcctgcaggtgccttgttgctggcttgtcttcagaaagggactgttctgggtggctggatctccagggtaccctccaccccagctgccaagccctgggccagcagcacccccttgtggccatcctgtgccttgttcccggtggcctccctattggactactaggaggggctggcagggcctccatagcacagaattgccccaaagccttgttaagatgagtcaagacccctcccccgcttcctcccttcctttcccccttcctccctcccccttcataaaggcctcccttgtcaccttccctcccaccccgtctcagccctgtgctcctggaggccctgctcccaaaaccgctggaaggactggggcactttctgccacagtagaacacagacagggcttcagatcacccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaaggcaggctttgttggta

SEQ ID NO: 173224 - DNA, 636 bp, Homo sapiens
  Payload ID: 14045
  Gene Symbol: RAB3IL1
  Gene Name: RAB3A interacting protein (rabin3)-like 1
  ENST ID: ENST00000526200
  CDS Start-End: 1-198
cagcaaggcctggtgcggcaggacgcccattctgcaaggcctggctccccgctcctccaccaacctttgctcgctgctgagtcttctcctgaaccagtctggcccgaccctctgacagagcccatgttctgggagatcatgaggttgcggaaggagatgtcactggccaagctcggcttcttcccccaggaggcttagggcgcggcccaggcctgaaggggagctctgagacagagcaaacacccaccccagaacaagccgacacacagggagacgggggcctggagccagccctgagccagaggcagaatggatggacagacaggccatggaggcagcactgagccagcaccacacgtccatcctgggacagacgggcctggacttcacggcaagacccccctctcttccccactgggttctgccaccaccaggaggatttcaagaaagcaccaaagaccagggagctcggatccatactcggggggcctcagcccttgggaggggacacctgaggcagccagcgccccctccccagtccccagaactgcctgcaggtgccttgttgctggcttgtcttcagaaagggactgttctgggtggctggatctccagggtaccctccaccccagctgc

SEQ ID NO: 173225 - DNA, 866 bp, Homo sapiens
  Payload ID: 14045
  Gene Symbol: RAB3IL1
  Gene Name: RAB3A interacting protein (rabin3)-like 1
  ENST ID: ENST00000531922
  CDS Start-End: 76-866
ggtggggggaagaaggctcctgctacctcccttcccggcaccctccagagggaccctcagtctggccttgcaagcatggactcttctgaggagcacgctgggtgccccgcccgagggacatgtcccgtgttcctggccatgagtgcagggactgtccgctacgccccatcaggcctgtgccctgtacttgaggggaacttgagagaagagccctggggcacagacagcccaccccagccagaccagggcctcccgccgccccttgcagctgtcccggtcccctggaagagcacggacccctgccaaggccacagggagtccccaggagccctggtggagacctctgcaggggaggaggcccaaggccaggagggccccgcagccgcccagctggacgtgttgcgcctgcgcagctcttccatggagatccgagagaagggctccgagttcctgaaggaggagctgcacagagcgcagaaggagctgaagctaaaggacgaggaatgtgagcggctgtccaaggtgcgggagcagctagaacaggagctggaagagctgacggccagcctgtttgaggaagctcacaagatggttcgagaagccaacatgaagcaggcggcatcagaaaagcagctgaaggaggctcggggcaagatcgacatgctgcaggcagaggtgacagccttgaagacgctggtcatcacgtccacaccagcctctcccaaccgcgagcttcacccccagctgctgagccccaccaaggccgggccccgaaagggccactctcgccacaagagcaccagcagcaccctctgccccgccgtgtgtcccgctgcgggacacaccctcaccccagacagagaggg

SEQ ID NO: 173226 - DNA, 1528 bp, Homo sapiens
  Payload ID: 14046
  Gene Symbol: RAB3A
  Gene Name: RAB3A, member RAS oncogene family
  Uniprot ID: P20336
  ENST ID: ENST00000222256
  CDS Start-End: 180-842
ttatctacatgtgaggctccgcccctccctttgcaggacgtcacggaggactgcaggggcctgagccgctgctgccgccgccgccgcgcagccccacatcaacgcaccggggtcctgtcaccgccaccgccaaaaaagtcaccgccgctagggtcgccgttgcatcggtgcagggcaagatggcatccgccacagactcgcgctatgggcagaaggagtcctcggatcagaacttcgactacatgttcaagattctcatcatcggcaacagcagcgtgggcaagacgtccttcctcttccgctatgctgacgactcgttcacgcctgccttcgtcagcaccgtgggcatcgacttcaaggtcaagaccatctatcgcaacgacaagaggatcaagctgcagatctgggacacagcagggcaagagcggtaccggaccatcaccaccgcatactaccggggcgctatgggcttcatcctcatgtatgacatcaccaacgaggaatccttcaatgcagtgcaggactggtccacccagatcaagacctactcatgggacaatgcccaggtgctgctggtaggaaacaagtgtgacatggaggatgagcgggtggtgtcatcagaacgtggccggcagctagctgaccaccttgggttcgagttctttgaggcaagcgccaaggacaacattaacgtcaagcagacctttgagcgcctggtggatgtcatctgcgagaagatgtccgagtcgttggacacggcggaccctgcggtcacaggcgccaagcagggcccacagctcagtgaccagcaggtgccaccgcaccaggactgcgcctgctgagagccatcccactccctttcccctcttccctgtcttccccaccttcccccaactacccgggcctgacccggcccctaccagccacgggcacaagacccctgctcctgacttagcccgtcacccttatttattattgtagctatttatttatttattgaagatgtcccccaggggcccaggctcccctgcccgccccaagccctgcccctcctgtacatatagccctttccccactcagctgtggtgtctcgtggccccgtgaactcaccgctcaccctcctgaaccccccccccccgcctttttttaaaattcacccccatccacagttgtcagttgtgaagaggggccagatgacaccctaaagcaggctgatcgggcaatgggaggtggccaggcctgccagcccctcggctctgccgcggtgggccgaggccgctgttgggggtttccctgtgtggaccatggggatcagagtctggcctgccaggctcctctccccgttttctcttttggtgggggggtgtgctgtgggtattcaccaccctgggaccccccccccccccgcccaccagacctgttctgacctcatgagtgtcaaacgtgccccccagttccttaggagatgtcatgacaacactacacgcacccaataaagcgaatggaccatccatgtgtgtccctgtga

SEQ ID NO: 173227 - DNA, 579 bp, Homo sapiens
  Payload ID: 14046
  Gene Symbol: RAB3A
  Gene Name: RAB3A, member RAS oncogene family
  ENST ID: ENST00000481914
  CDS Start-End: 233-579
gagccgctgctgccgccgccgccgcgcagccccacatcaacgcaccggggtcctgtcaccgccaccgccaaaaaagtcaccgccgctagggtcgccgttgcatcggtgcagggcaagggtgtcctccatacaccggccgttttctggagcccttgccatcttctgcctgggcttgggcacatgaggatggagagagcccccctcacggctctgctacacccggtatccccagatggcatccgccacagactcgcgctatgggcagaaggagtcctcggatcagaacttcgactacatgttcaagattctcatcatcggcaacagcagcgtgggcaagacgtccttcctcttccgctatgctgacgactcgttcacgcctgccttcgtcagcaccgtgggcatcgacttcaaggtcaagaccatctatcgcaacgacaagaggatcaagctgcagatctgggacacagcagggcaagagcggtaccggaccatcaccaccgcatactaccggggcgctatgggcttcatcctcatgtatgacatcaccaacgaggaatccttcaatgcagtgcaggactg

SEQ ID NO: 173228 - DNA, 1253 bp, Homo sapiens
  Payload ID: 14046
  Gene Symbol: RAB3A
  Gene Name: RAB3A, member RAS oncogene family
  ENST ID: ENST00000464076
  CDS Start-End: 205-582
gcaggacgtcacggaggactgcaggggcctgagccgctgctgccgccgccgccgcgcagccccacatcaacgcaccggggtcctgtcaccgccaccgccaaaaaagtcaccgccgctagggtcgccgttgcatcggtgcagggcaaggacacagcagggcaagagcggtaccggaccatcaccaccgcatactaccggggcgctatgggcttcatcctcatgtatgacatcaccaacgaggaatccttcaatgcagtgcaggactggtccacccagatcaagacctactcatgggacaatgcccaggtgctgctggtaggaaacaagtgtgacatggaggatgagcgggtggtgtcatcagaacgtggccggcagctagctgaccaccttgggttcgagttctttgaggcaagcgccaaggacaacattaacgtcaagcagacctttgagcgcctggtggatgtcatctgcgagaagatgtccgagtcgttggacacggcggaccctgcggtcacaggcgccaagcagggcccacagctcagtgaccagcaggtgccaccgcaccaggactgcgcctgctgagagccatcccactccctttcccctcttccctgtcttccccaccttcccccaactacccgggcctgacccggcccctaccagccacgggcacaagacccctgctcctgacttagcccgtcacccttatttattattgtagctatttatttatttattgaagatgtcccccaggggcccaggctcccctgcccgccccaagccctgcccctcctgtacatatagccctttccccactcagctgtggtgtctcgtggccccgtgaactcaccgctcaccctcctgaaccccccccccccgcctttttttaaaattcacccccatccacagttgtcagttgtgaagaggggccagatgacaccctaaagcaggctgatcgggcaatgggaggtggccaggcctgccagcccctcggctctgccgcggtgggccgaggccgctgttgggggtttccctgtgtggaccatggggatcagagtctggcctgccaggctcctctccccgttttctcttttggtgggggggtgtgctgtgggtattcaccaccctgggaccccccccccccccgcccaccagacctgttctgacctcatgagtgtcaaacgtgccccccagttccttaggagatgtcatgacaacactacacgcacccaataaagcgaatggaccatcca

SEQ ID NO: 173229 - DNA, 12844 bp, Homo sapiens
  Payload ID: 14047
  Gene Symbol: RAB3B
  Gene Name: RAB3B, member RAS oncogene family
  Uniprot ID: P20337
  ENST ID: ENST00000371655
  CDS Start-End: 214-873
agactccgcccttgggcggggcctggatgcggccggagcggagcagtgctggagcgggagcctcagccctcaggcgccactgtgaggacctgaccggaccagaccatcccgcagcgccccgccccggccccctccgcgccctcccgacgccaggtcctgccgtcccgccgaccgtccgggagcgaacccgtcgtcccgcactcggagtccgcgatggcttcagtgacagatggtaaaactggagtcaaagatgcctctgaccagaattttgactacatgtttaaactgcttatcattggcaacagcagtgttggcaagacctccttcctcttccgctatgctgatgacacgttcaccccagccttcgttagcaccgtgggcatcgacttcaaggtgaagacagtctaccgtcacgagaagcgggtgaaactgcagatctgggacacagctgggcaggagcggtaccggaccatcacaacagcctattaccgtggggccatgggcttcattctgatgtatgacatcaccaatgaagagtccttcaatgctgtccaagactgggctactcagatcaagacctactcctgggacaatgcacaagttattctggtggggaacaagtgtgacatggaggaagagagggttgttcccactgagaagggccagctccttgcagagcagcttgggtttgatttctttgaagccagtgcaaaggagaacatcagtgtaaggcaggcctttgagcgcctggtggatgccatttgtgacaagatgtctgattcgctggacacagacccgtcgatgctgggctcctccaagaacacgcgtctctcggacaccccaccgctgctgcagcagaactgctcatgctaggcaaggcccaccttcctgacctcccctcattgtggccccacacccagtctgcttctccctgttacacactgtccgctctcagcccactctccctgttacacactgcccacactcagagcaagatgagttgctgctattctttgcctgcccctggggttctctgcagatggtcccagtaatagatactcagcactagactaacataacaggtcactacacgggtgcagaatcactttacaaaagaagactctgttttacgaaggggattcactacagggacttagagaacagtctcttttctgcctttaaaatgagagttcctccatttaccaaaatttgacacgcacacattcttcaggggcatgccaattgcgtaaagtgaggctcgcctgcatagctaatcctgttaaagacaacttctcaaagcacaacgtgcttgtttcctatcgggctccctgcggggctttctctcactacaagtcaagcttgggctctcaaagccctgcgcctgttaccacggatgcccacagggcctgggcagttgctgtggcgacaggaagagctaatcttcagagagctcagactctctaatgatgctgaaggagcaaaggctgagtcagaaacacacttaagagaaaaggattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaagagaaaaggattatcccctacaaaatgtcagaggttcctgctatatgaaagagcaagtaggtatgctcaagaaagacaaacagagaaaaagagaaacaggcaagatcaagaaacagatcatgagtttctgattttgctgctttccagttggttcttaactgtgggaacttagtgaaattggttattagttcttagactcctagaacctgaggattttagatttgacgggatgcccaaatttacctagtctgactagtcagttctaaccttcctttttctgacaagtgactgtcaagcctaacaatcaaatctctttcttttaaagcacaccttctaggcagggacaggagctcattttccacaccatctttgtcaactctcatagaaagttttccttgtatcgagctcaaatctgcctcctggaaattcttcttcttcttccctccctgttggtaccagctctgctgtcagagacttcacagtctgtgctccctctgccctgtgacgtcttcagactatttgagaacaggaatcatgactcctgggacttgccttttctctaggtcaaatacctctataattccatctgctgttcttcatagggtcttctccctatcctgcccttttcctccaatccatcttttaactgctcttgagcagtctaactgagaagtatgattcaaagcaaaataaatcttaaggtggcatgactctgaaaaaattgagaaaattgaactcagagatcccgatcccaacccctttctcctgggagtgaaaccttagtttctaccagagagtgtgggaaaccacttctggtggaagccccttaattaaatacctgaggaaaaaaataaaagaaactcagagaccagaataaattagctcattattctagcttgcttggccacagggacatattttgttttggctgaaataatgacatggaactggcagtgattccagaaaacctttcttctctatcatggcctgaatcctcagccacctcaaaagtcagcgggcaggaggagtctctcgccagttttcttttcatttcaaatgaggctcattgtcctagaaaagtaattaactagcaaccagtccaatgactaaataaaaggaccatccagctgtggctcacacctgtaatcccagcactttggaaagccaaggcaggaggaacacttgaggccaggagtttgagaccagcctgggcaatgtggtcaaattctatccctacaaaaaaaaaaattagccagatgtgatggtgcatgcctgtagtcccagctacttgggaggctgaggcaggaggattgcttgagcccaagaatttgaggttgcagtgagctgtaattatgccactgcattccagtctgggtgacagagtaagaataagaccctgtctctctgtctctctttctctctttttttttttaaaggagtcagctctacaaagatgttgctttctttgatgcaatgcagagagcagagctttggacttggaatcaggagacccggactctgtcattaaatcaactgtgactctgggccagttactttccacttttgagtcttgatttcctacttataaaatgagggagcttatttggatgatctttaaggtctcttttggcactaataactcggtgtctcttttttttcaccttcaccatttcagttgatccaccaaacaaacctgagagatcaggattggcatccaagagttgtctcggccaactctgatgtcatgcttactctgtactagacattgttccaagcattttacgtgcattaactcatttatcttcccaacatcttgtgagggaggcactatagtgagcctcatttgaagatgaggaaacaaaggtacaaagaggttctagctggacctctaaagtcacataataagtaagtggtagagctggagttcacatccaggcagtaggctccaaggtctgtgctcttaaccacattctgggctgcatcttttatagacaaactatgatccagagagattacgagacttggatcacataccaagagagtgttaaagccacattaggattcaattccagggccatcagattccaagtccactggagaaaagatgtatatctctaatctgttaacaaattgctcaactactcagactaatcccaggtgatggatgtctaatgctcaggaaaggcgagtcagtctctgaggcaacagatcccatgggcctgggtagaaaatgcccagtgcttcccagtcccaagtgctggctttccctgtatctgcctctgccaggcaacacttatcaggctcccaatcagcaggagcctccatgctccactttgaacagcctctatgctccagcaatggggcatttgtgaagagtgacttgattaacttttctgaccatgggtataatacagttgcttcagagggcagtggttctgggtgtgatttttacactgtaacattgtatacagtgtcatggataattactatttttttctggtcattaacactcacctactctagtactaggatttcagaccaaggtcctcatgacgcctggatattttagtatctatatccaataatcttttctctcctactgaatatccaggcaaagatgaaatcgttttctttaaaactgtcaaattctgtaaaactcaggagccagttcaagggaacaagcatcttcacaatagatggaatcaagagttaaatgttatagtggcaagcttgtctactgggcaacagacaaccagacctgcttgtgagatggcagctccccagccctgctctgtgacctcatttctgtcaaatgaaaggcagcagcttccagctgattgcagcatagtgttcatcaatcacagtaatagcgcaattagccaccaaggttcaagctgtgtaatatgtgttagtggcaacttgtcctggatttaatcttcctcaacaatccaaataaaatatttaaaaactcttgacttctggctgggcgcagcagctcatgcctgtaatcccagcactttgggaggccgaggtgggcagatcacctgaggtcaggagttcaagaccagcctgggcaacatggtgaaacccccatctctactaaaaatacaaaaattagccaggcgtggtggtgggcacctgaaatccctactcaggaggctgaggcagagaatcgcttgaacctgggaggcagaggttgcagtgagccgagatcgtgccactgcacttcagcctgggtgacagagcgagactccatctcaaaacaaaacaagcaaacaaacaacaacaacaaaaaacacctcttgacttctaaagacgcaaaagtggccaaaagtgcaatacagtattgtgtttatttacatctattttaaatgcatgtgtatctgtaaatacaaagtgattcgtgactcattgtctcctcagtctatagcattattaacttctaggagcagcagtggagtagagtgtactgaatggtcacagactcatcgattatcagatctggaaaggagcttagagaagatctgttccaggctcctattttatagaagggaaggttgacatccaaagaatggaaggaaatctcctaattattctgagagtatcacagtgatggagccaggactaggtcctggatcacctctaagaagacacttagctatttgactatcgactagggcctagcattattaagcactagataaatacagatgaaaaaaaaaatgatccctgcctgcaaggtcctatgatctaatggagatgctgtttctaaaatattattatcccaatttggcagtcaaggaaacagccctggaaaagttaacatgctcaagtcacccactagcatcatttgaaccctcctctgtctgactcatgctctttcaaatttttttcttcagattgtcttagcagaagggtagatgggatataccctctggtagtaccaggctcccaaggattcttagagttaaataacctcagttaattaaatagccacaattgcttggtgaccgaagccttataacatccacagaataagaccattctccagacctgactccccaactcatatcacctgctcctgccggccactaagctccttgcttggatatcgagttttctggagtatcctgaggaatgtttgtttgactttgtttgccaacagtttaggggaaggggaaagaactacaataaccagtgtcctgggatctcattgatttcagattccctgccccaagcctacacccaattacctgccatagttggggaatcaagtagcatcctgtggctggaagtaaatgcaaaacactagtccgtgagatataaatactgttaaatgatggttttttaaggtcctgatccattatatgaagtagacaaaattcaaatttatttattcatttattttctcaacaaatgaatatatattatgtgccaggatacaagtagtggcaaattagacacagttcttgctttcatgaaacgtatagcttcatgatttagtatagacattgtcaaatcatcacccaaatataattacaaagtactctaaaggaaaggcacgtgatgctgtgagaacactcaactgggaaaccggaatcacctttgagaaactgtttcaggggctcttggaagagtctactgctcccaaatatctctgctacccactggccattgctttacattcctcaactaagctttcaccttttagtactaacctttgatgactgatcaaatacaaatgccccaagaagactgaggataggagaaagaatatctctacctgtgaaacattgttagactgcctggctaggagttcattgttgttttctgaaggacgtaaccaaccactccaaaacttacaggcttaaaacaacaaacatgtatcatttcttatgattctgtgggttggctgggtggttcttctggctgaggcaggatggtctaggatagctacatccacatgtctggggtcccagctgagatgactggggctgttgaggcctttctccctgtggtgtcatcctccagaaggctgcccagatttgtccatatggtagcaggagtttcctcgaagcaagagagggcaagatccaacacagaagcacttttcaagctctgtttccatcacatttgccaatgtctcactgatgaacacaagttccatggccaagtccagttttaagaaatggagaaatagggcttggctcagtggctcatgtctgtaatcccagcactttgggaggccaaggcatgcggatcatttgaggtcaggagttccagaccagcctggccaacatggtgaaaacccatctctactaaaaatacaaaaattagctgggtgtggtggcgggcatctgtaatcccagctatttgggaggctgaagcacaagaattgcttgaacccaggaggaggaggttgcaatgagcctaaatcgcaccactgcacttcagcctgggcgatagagccagactcagtctcaaaaaaaaaaaaggggagggggaaatagatgccatctctttatgggaggagctacaaaatatggtgaccaatttttcaatctaccacaggaagcaccctcagtcctctgaaactaagtctggtagatgtcctggggtcttaaaacatggctccgatgatatcaccaaagacaagtggcaaaactgtatagggcagggcagtcttatcatttgtttaatagtgatccaaaggatttactttggaggaatcaagacactcgagatgaagaagttttgatgcttgttaaacagtccatttggatacctcttagctatccccgagggatgaatctgacttctcatttcacaggattcaccgtagataatggttgtaattcctaccggaagttcctggccagaagcccagcagaaagattcagtatatatagaaaagatggctccaagaacagttgggccttctgttctaactgtacttccttctttgatgtactcgtctagtcccgaggctttagatgccaagtctttgataataacgtgtatctaagtgcctactggacattttcatgtctcaaacttaacatgtccaaattgaaactcttgattctgcccccaaacttgtttgaaccccagtcttcacagaaaactcatccttaattctttgatttttctctttttctcagcctccttgtctaatctagcagcagatcctagggttttacttctaaatatatctcaaatctgatcatttttctccattttcattggcatgaccttggtccaggccaccattgttttctgccctagagagctaccacagagttcctaacatttccctacttacgtaattactccactctagtccattctgtctcacaggagtaacattttttatatatatatatatatatatatatatatatatatatatatatatatttttttttttttaatagagacggtcttgctatgttgcccaagctggtttcaaattctggcctcaagcgatcctcttgccttggcctcctgagtcactaggattgtacgtatgagccaccgcatccagcctcaatggcaatctcttaaaaatctaaataaatgaacggctcagtaacactgaggtttacttcacacaaaaacaatccaaaccttggcaagacggtgaaaccctgtctctacaaaaaatacaaaaaattaactgggcaaagtagcctgcacctatagtcccagctacttgggaggctgaggtgggaggatcgattgagccctggaggtcaagaatacagtgagccatagccatgattgtacactgtgccactccagcctgggtgacagagcaagaccctgtccccctctcaaaaaaaaaaaaaaaagaaagaaagaaagaaaaaaaagaagaaaaggaaagaaatgaagagaattcagagacttccattattattaatacctattttattgattctgtttctagccctgagtccgctcctaacttgctataggatctctggtaaatcatttcctgtaataagcagctgtcacctctctccttgtttcttccagaaatagtaatctcttctttagtagtactactactccctaacccaaaccaggtgattctagtgaagactgtcaataaacggagcatgtgatcaagcagggcccatcagaatccttccctaagatttttataaaaagctggacctattctttttccatttgagtggcaaatatttgaagatatgaggtctaaagctgtgatggcttattctccatccctgtgtaaattctggtctatagtaagcgaaaacaaggccattaggcagagggcagcagagacataaggtgagaaagagtgtggtctctggttttctagaccctgattctggtttggaggcttggctgatcacctcttcctttgattctgatagaaagctcaatgtatctttctaataaaacccccctttgctttgcttgttggagttaggttcttatcccttgcaaccaaaaatatattgtctcttcttttgttctcagttttctcatttatatatccttctagctccaaagcacagaaattctaaaacaaacaaacaaacaaacaaaaacaaacaaaaaaaacctgggtcattcagaaaatcccactgatatagactttctgatccagaatgtataatctgaaaagaagcctaccctcgtctccatcctctcttcttgtacctgaaggaacgaagaagagggatttctcaaggtgagaagcagttctccatggacactgatgacagcacaggcaaagtttcctatgactagggatcactgtccacacagagtctggcttcccaggtatccagcaggtagacaaaacagctaactccactgccactcctttctccacatccgttcctatttctcagccatctcagtgacatccgccatcttgagagtcaactactgactggactgagttgtgtggtatatgcttctgtttacttctcttctgtcttttttaagtggccaaatagcaaacgcttaaataggaaatctctgggagacttgaataaaagactttgcttggtagaaaatcatgtcacagaaaggctaatagacagcaaagtaaatcagcaagtccctgagcagtaggattaggattcctgtctcctttcagattcaaatgcatctgtttctggggttaacagtggactgttaagaggctgtgcagcttgggttaagtcattcttatctctgggcttcaggagcttagaccagatagtttctacaggctctcttggtgctgatgccttgggattctgtggctgttttctgtaagatctgcaagggggaaacaggattttggcagcaatcctttcattactaaagcttcctttcttttcgggtacagtgaaaagagccaaggctgtgtgaccccctcatcacttagccaggcgtatggtcctggtttctgaggctgccagaaagcatcttagcaatttgtgtttggatggtccatgcctgactattctaggctggaggttcctaaagagtaacaagaggaagagaaacaagaatctctgacacttgttgagaatagagcacagtcccatttgtttgaaaagagacaccaggcagccatgtttatgtgccagaaatgcattccacctcaaggaggacttaatttatggacccgtgtgtgccaggctgagctgggcaagatctttctcaggacaaactctgccatgcagctaaaagcctggaaactaaaggatttcatgtagtaaactatcttccaacccctgtagacatcagaccacaggatgaggtttcagaaggtcataaggcagaatagttaagcctacagggcttacagtctgacagacctgggttcagttcttgggtcttcatcactagttttgtgacttcgggaagatgactcccggagcctcagtgagcctcagttacttcatatgtaaatgaagtaatactatctacttcacaaggctgttgaaaggattaaatggagaatgggtgtaaaacccttagtgcagtgccgtgcacacacagtagatgccgaacgtgtgatgttggcactacacaatgtgtaatcccaatcaggcagagctaggcaggcaaatctaatccaggatctttgtaaggggactgagaaccagagactggagaaagccagtgtaaacaccatgagcaaaggagcaagagaaggggcattgtgtaagtaggagatggagcttgaacttactaagtggatcagggtagaagaatccagtcaggaccaagggaggagagtccaggaaaatgccatgagcagctctgtagcatgaccttgttgggctgggttaaagtagggtctgccaccagtcatgtgacagaaaggtacctcatgcacttcctccttcccccagaaatcagcctccaggagtgaggaatgagcccagaatgagagtttagagtgctccagagcctttgttagaggtgccctccgacattcagaaaaccaggattccagagacctgggtttgagtcctgactttgcagcatactaactgtgtgatcttgaaccaacatattttcacctaatgaggctgacaatcttccctacttcacaaaatagttatgagagtcaaataaaagtacattttagaaagtgaaatgctgtggacatttaaggtggagccactgtgagagtctagggggatagatggtattcgtctcagaatgaaacgaatacacccctctcagagccctttccaaggatcccctccttctttcagctccttccctccacctcaatacacactcctgtcccaggaacctaacctcatctagaaataccagggccagcatgccttacacctagaggtttggttggcttcagagaaacttctggaggctaaaagcagccaagaagaatcagccactacatgctgggcctggatgaacagagcagtgagctgtgatggggctggggctggggcccaggaggagcaggcaggagagtttgtatgcaccgtgattcaaatattataacaaaaatcatcgatcatgtgttaggcactttacagttcccaaagcactttcccatccatgccctgatgatctttgacacaacactgtgatgtgggttttattatttccagtacagatgaggaagactgaggcctgcatcagtgaagcaacctatccaagactacatagagaaggcagtaaatggcagggttagtctcagaacaggggagggtctgttccccccgcagtgggcagtcctaattctgaacttcacctatctgggggtgatagaggggaacaagaggaagcctgctgaagagaaaacctaaacatctgttttgtctacgtatgacttcctctgcttgtgggagagaaggaaggaaaggaacacattgttgtcagccccacaaccccaacagaattaaaccctggagcaggttgaacagcagaggcttccctcagatcaaggagccaggagcagatgatctatctctgtggccacacagagagatgtcaccttatgcaatttgcatatcatattcaattcccccaactgctctttctaatttattcaactggggaccaggctggtctcatgccaacctaggagatgtaccatagcagtatgagcagaattcctcaggaggaacaattagcaaaaactgcagttgcctctcgataggcctgagcagagagaggaacaatagctctcacgtctctcctcatcagattctaactaagcagatgttctcatgcttttttcttcttcctatgttctgtatactgacacctcttctcagtggcatatgaaatatgaaatgtcatgtgttgtgagtttgtataaatataaaggaatatatatacacagtagcaaaagagaagatctcatttacaaatatctatggtgtttccttgttctgtgttgatctgttttattgatacaaactgaattttcttaatgtatcttctatctctattatagtggcaatgatggtatatgcattaaagttcttctgaattgtg

SEQ ID NO: 173230 - DNA, 8896 bp, Homo sapiens
  Payload ID: 14048
  Gene Symbol: RAB3C
  Gene Name: RAB3C, member RAS oncogene family
  Uniprot ID: Q96E17
  ENST ID: ENST00000282878
  CDS Start-End: 170-853
agtacgcgtgtgcggcgccaggagaggacagctccagtgctgatgttggagccggttagcgaaccccaagagtgcagagtgtggagcgtggagcgccgggactgtgcacgcttgaccggaagcccagaccagtgcggtcctagccagagagaaaggacatttgccaacaatgagacacgaagcgcccatgcagatggcctctgcccaagatgccaggtacggccagaaagactcctctgatcagaactttgactacatgttcaaattactcatcatcggcaatagcagtgtggggaaaacatcttttctattccgttatgcagatgactcctttacatctgcattcgtcagcacagttgggatcgatttcaaagtaaaaactgtattcaaaaatgaaaagagaatcaagcttcagatttgggacacagcaggccaggaaagatacaggactatcaccacagcctattatcgtggagccatgggctttattttaatgtatgacattacaaatgaagaatccttcaatgcagtacaagattggtcaactcaaatcaaaacatactcttgggacaatgcccaagttattctggttgggaacaagtgtgacatggaagacgagcgggtcatctcaactgagcgaggtcaacatttaggagaacagcttgggtttgagttttttgaaacaagtgccaaggacaacattaatgtcaagcagacatttgagcgccttgtggatatcatctgcgacaaaatgtcagagagtttggagactgatcctgccatcactgctgcaaagcagaacacgagactcaaggaaactcctcctccaccgcagcccaactgtgcctgctagtgtccccgtgcacacaggcagctccagggggctctggttgccaacaaacagcatttgtaaatggtctattagccttcatttatactgcctaacaattatttgaaggaataaattgatgtcaatggctcgtacgcattcaattcttgggagctttcctgtttaatatgtggcaaatatgtgatcttaaatttataaggactatccatctataaacatctggtacctgcatgtgacttgttatttatttgtctgctaggctctttttgtttcaaatttgttctcagactacttctgggacatcagactataatctcactacaactggcttttgtcccattgattcaaattatgctattcacttgtaggaatgatgaccaaggaattgcttgtgtgtgtgtgtgtgtgtgtgtgtgtgcacgcatgcccgcatgcgtgcagaggaagaagtcacaagacttcatttgctttactcttagttgaaaatcaaatggaagtttttctcatgattagggacgctgtcacgagtctggtcagtttactgttgggaactgtgtctttatttcactgttattaataactgagatcattggcctataaagaaattgaaatgttgtttttaaggtccttgcaattttcctaagtcattaatattacctgactggggctatttaacaataatcttcgtttacacatttaaataagcaagtatctacccaggactgctttttccactgatccttcccaattctgtgaatattcaacatcattgaacagattgagacatatctactgaatgccagttatgcaacaagcattttaaccaagaagggtatgagtagctatggaattccaaggtccaagcccccttatttttcaatgacttgccttccccaacccccataatgcacaccaccaccaccatcactttctggaaccatcaccaactcttggactagagcttatgttgaagcttgttagggctcctctttccgtaggatgtagacttgcctccccaaacacggccatcttctcaaacctcagctaagttcttttacctgtttagatgctatttaaatcagatttcaaagggtccccagttgagaaaaaggaaaattttaatctttaatcatctttttaagtccagatgttcataaattctaaagcatattcctattacgtgaatgcttaagttacacaggaaacattctataactgtagtatttcaatttcagaaatatttaggatccatagcaatttaaaagagggaggaaaccactggagcattctaattttgtatcacaaacttcctaaaggacctatatgaataaagagaaaacaacaaatcctaccagctgtacagagagcaacagggaaatttggcctctgtatcactgtccagcattatttaaagctaggatttaggaaggaagcaggaattatttggcagatttggaaggatagtttcgttaagtgaactttctacttttttggtggttatgtcaaagaatttttttcctcttctcaaaaatagagaggcttcccatgaaagtattggatgcaaatgaaacaggcatacatctaaagatatctttggagaataaatccttacaagtcacagaactaggtcacacacattagtaagtcaaaagttggaaattaggggagagagcatttggaatgctttaagcatttccatgttatttctcaccttcctagttgaagatccactaatcagtagtacatttctactttggtgccctacaaagcaaaccttagcatagtaaagacaagaaaacattaatgttttattagtttttaatggggcaaccaacttcaaaatcacaggaattacagtgacgggagagaaagaagcaggaggcataaaaacagatttgtttgtagcagtagtctgtttgtacaatgttataatatttctgtaacttgggccagaatgtggccatgttaaatgatatagctattaagctcacttttacaatctaaaaggaactaataaagccaggaaacccttctcatcctccttcacagccctcatcccacacatagatgtaaaaagcttagaaagaatattctgatggctttttcagaaggaaggaccttgatgtgtgtattgtggtaaaatgaaaagcaaaatgagacagtatttaaaagtgaaagagcagagttttgctctgctgaaaaccccttccctgaagaactgattgctgttgaagttaattggcccttagatgggaagccctaagccaagctcccacttacacagtgtcaaacatcccgaagtggaaacattttatgccagtcaggggagagacaggcaacaatagcccaaatgtcattgccaagaaacatctgatactttctaatttctaaaccccaatggaagtgaggcctttttcattgattctcagttctgaaactcccaccctgttaggatttccattccaaataattcaatgagaggtttccagagaaacagtcacagagctcaagagaaagaacacttaaatgctcctgctgtaattgcatcaaaaaatccgggttttaacatcaaatttggcaaatggtgggaccaacccaaggttaactaagtgggctttcattggcattgagctatgttacttataaattataacactatagttccaaggtttttcagccttttggccaacacacacacacacacacacacacacacacacacacactataccatcatctatcaatagtctaaatacataaataaatgcaggtcatttttatcaatggcctaactaaatttatatttaaaagaacaagacttttaaaaagtacatactcctgttggtttgtaagttatacacatttatctcttgtctttgatttaattaaattagtgttttaagtatgaatttattttcctttgctactcattacctgaccactttcactcctctagatacccttaggaataaacctgaactgttccaaatcgattcttccaagagctttggtgttggtaccttcctttcttttcctaatgcaactgaaaaattagactgaaaattatttgacttaaatagccatcctcagagtgaatcagcatttcagtttttggagatggggatggaagtagaaggtgcacaaagcgtcctaagatggcagtttgaatgttagcatcgcatctacatgctcataagaggaattgcttcaggacaatgaatcagttcattgttgctgcccccagtgaacagctccaactgccttgatgaacttctaatgactgtgaaagctaggaggttcttctagttcctccttagggtcacttgaagttcagtatttttttgctgcctggtaactaagtgctaagatttttacttggaaagaaaactatgacaatgccttcagttgtagcagaaagttgtggcattgtgataataaacaaaatctacaaagttacaacccaaattatacaagacatcaaaacactcagtaaacaaatatatatatttcacctacttaaatcttattcatattaattataggccttttgtttagtacactggttattttttaaggaaccaatttaaactttcaattttaaatacatctatgctgacgatagactttcgggtatatacaaccttcttcttctcttttaaaagttaaatacattccactattaactgaacttccatgaagcaacattaattttagagcatggtagtccataatcagtggttcattgtgatgtgctttatccaacatgtatcttagtgcatggttgaggatgtactatgtgatattttagttaacagtgtggcatttgtgggactatattaaaagcatatccaaactaccaagctataccaagctgaggtaggtaacacctgcatgtgaaaaactgtgatatgaatcttatttataaaaaagtcataactaaaacccttctagaccaaaaagttactgtgtgtttgttaataatcttcatagtactactggaatgctcaatcagttatttttggtgtggcatacttcagagctggcctgtccgtctgaagaaccctttctctcacaattacagtttgcatgactagaacccggaactctgttcctttgcgtgtatagtcacttagtgtgctgtccgggtgccacatgagcaactacacccatgtggcctttctgtcactccctggaaaatgcaacctctacagctctgctcagctctgcctgtgtgcattgattaccttcgctttagtagtttgcctgtaaaatggtgaagtctttctgatatgctgaacctttgagccagcttttgggagttcttcatattttaggtgaatttttgaccaaagtcaattaaagacataaacctgttttatatcatggaatttactgggccaaattaagtaaaagatgaagtttatgaccagaataaaaaagcctttacccctgcacagcactgtatctaaagggctctaggttgtagaaatatagtaccccctaacagggaaaaaccaagttgggggatttatctaaaatgtatctacctattgttactggtatttcacaaataatttttttcttaaaaatatttacagaaatgcttgacactccggtcaaataatatttccctttgatagattgaaatatttgcttttagattacacatacagtgctgcccttctcaacagtcactcacacgctcactcgcctgtacaaaggtatcaggcaaacactgatacttttttttaagaaggcaaaattccatctatggtgctttctcagtgctagggaaaagggagcttttactatgttccagctataactcacatcttacttataaggtccataaaatcggttcttcacactgatttcgtttgattagtctgtgcatgtaattaatttcctccaaacagagagagtggaggggaaataaattttgcaagcattctagataacagaaatgagtcattttaaaacctcactcagagctcgagtgttaagatcagaccatctagctagtggacaaattgaactttctatttgcagttctcttttactttctgactttcttttaaattactgcagtttttcaaaacactatcctcatggaatgacaggaccaagaatagaaaatgagactcaaatttcaccatttacttcccatcagcaaccattactggtggagtttcaaacagtcattacttgctgaaatgaggtttgaggttacctgtgtatttcattcacctgtgttaatatttccttcatcgtggacaagtgagagttggctgtggctttatttcttgaggcaaattattttgcattcatgttatttggggctaggtattgcttaggttcgtgaatgctgttcttacagacacagatggtacctgagcccctcagacacctgccctttcagggacgtgagcatgacttacatctgtcaagtggttccatacttcttgtaaaagtaaagtttgggtattgtttgctgtatcaatatgatggctttccatgcattgtctcattatccctaggatacgtgctaaaggaaaactgtcctgtaattcctgttaatatattgttaatgtcagacgtgatgtgataccgttagactgtccaaatgtacaacaatttaatggtgtttgtagaactgatatgtcttaaatgttgcatgaaatatgttataaaaatagatttgttttctattttcaacacctcagaattgagggttcatgggccaataagtgcaatatttaatgactcactcagtgtatataaactagtatgaaagagtgaattataatgaatgtgtgagatgctttgatagctgtgtgacttattcaaatgattttcttgtagctgtatttgtctagtggtgcaatttatacagtaaatatcttattggtgtcatgtaaaacccctctgtgcctacttcaaaatacttttttcttataaaaccaaacatttagtatctggaaatatgtgtcaattttatctcttagaattgtggattttattgtcaagacagaatggctgttcatttattttataaaagcatctccttctataactcaaaattttctttaagtgtcatataaaagtgtacattttacttttaagcaactaatttagatacctaagaaaaactatgtgcattaggaaaagtcatgtttttcttctcagaaaggttgatcacatgacatgtctactaagaattttcacctctgtacttgtatgtatattttattgttactcaatcttgtattttatttacaaattcaacactgtcaaccctgggaattctaaaataccaatgtatttttaggttgtagctaatgttgtattcactttcaattctcagttgtccacactggtgatataagaggaacaaatcagaatcattaaatactttgtaatgccatcataaactcatatattcatcctcaaactcccttgtttaatgctaattggtggcctggaacttcactgagatgcaaaatcaagaactgaagcctagttgctagataacgaaaagctataaatgtttatgtatgtgaattttaaattagaataaccgtcttaaactcctacttgccatttctaaggcaaagcattcattttaatattgtactttgccttttcattcagttagtggagtaagtcatgaaacccttaggaagaaaaacaagttatgacttattcactaaaattgatgcaagacagttggttctagatgaccatggccatgtgttcatcatataaaaccttcagttctctctatggtgcttggctggagattgacatgtgaggatgtgccaatcatattaaatggatttggtctatgtgggtgatatgtggcctgaatgtaactgtgatagactgaaatttgttcttagctctcaaaatccactgaagaagtcaagtgaaggtgggtaaaatagggagattagtgacaactttgtgccaaattttttaaaaaatggaagcaggtagccaatattagaatgataatttaagggtgtggttgaattttagttagttgtcacatagttattgaacctcatatgctcagtgctgtgggaatcaaacatggaagaggtatggctcctgcccctaatgagaacaagggggaaaaatccagatataatctaaatgctaggttatgtcagggtataggaacacagagaatgggggacctgtaagaactggaagagtcagagagggctccattgaagaggtcaaacataattccggaaagaattaggtagtgaggagattgtgccaggaaaataagtgggaaaggccacagttatgtttcctttgaatggaagagagacaaagctatcagctatagatcattgttttcttaagacagccaaactggccctttgaaaccattcaaattaccccagtttagctccctaccttttagtctccgtgaggaagacaagctgttgcattatcatattcctctgtgctgagcagctcaagactcagccacaatatgcaaattgctttaatgccatattacggcagttgatttagacatttgccagtgcaccaaaccatgagagattgtccgacctaatgccacctggcagatgtgtacccagagatttttctgtagctccatgtttcccataaagggcattggaaatgcacagatgaagatcttcctttggaaccaggcacatttggccccttctcagtgactgcactgtggaactcttcttaagaaaatattgaaaacagcttaatgctttcatatagtgaccgacatttagttgaaaactactgctgcatagcaaatattgtgactcttcatgtgtccacaggagctcttgtgtgggtttaaagctatgaagtgtattcacattgtgaagttttaattatctttattgaaattaattgtgtaaaaatggtatgtgctctattaggtattcagtttgtatgtgaattctataaagaaagtggtttttgttctttgagtttgttttatttcttgaagattacaataaatatctaagagactatattcctgaa

SEQ ID NO: 173231 - DNA, 4273 bp, Homo sapiens
  Payload ID: 14049
  Gene Symbol: RAB3D
  Gene Name: RAB3D, member RAS oncogene family
  Uniprot ID: O95716
  ENST ID: ENST00000222120
  CDS Start-End: 262-921
ccttcctccgccttctgggcggagcccgcgcgggatccgggtggctgcaggctgctggcttctgcggctgcggggtcggggtcgcggccagggccaagccgcagcgagttcacaggcggaacccctgcaggcggcgccccctacgcgaggtcacccctgggaaggagcgcagcccacccggcccctccgcatccgagcaggacgcccgtctcctctccctgaggatttcaggtctccctgtcccaggaggcttgtgccaagatggcatcagctggagacacccaggcaggcccacgggatgcagcagatcagaacttcgactatatgttcaaactgctactgataggcaacagcagtgtgggcaagacttccttcctgttccgatacgcggacgactccttcactcccgccttcgtcagtactgtgggcatcgatttcaaggtcaagaccgtctaccgccatgacaagaggatcaagctgcagatctgggacacagcgggccaggagcgctaccgcaccatcaccacggcctactaccggggagccatgggcttcctgctcatgtatgacatcgccaatcaggaatcctttgccgctgtgcaggactgggccacgcaaatcaagacctactcctgggacaacgcccaggtcatcctggtggggaacaagtgtgacctggaggacgaacgtgttgtgcctgctgaggatggccggaggctcgccgacgaccttggtttcgagttctttgaagccagtgccaaggagaacatcaatgtgaagcaggtcttcgagcgcctggtggatgtcatctgcgagaagatgaacgagtccctggaacccagctccagctcaggcagcaacgggaaaggcccggccgtgggggatgctccagccccccagcccagcagctgcagctgctagagatggcccccaaccccccacccacccctctcctgcctcggcagggactgtgatcgaggcgtgagccacagtggttatctccaagctcagggcaatcccttccctcctgtcaactgctccccgactcctgcatggctcattccttcacaatgtcgccgtggctgccaggttcctcaggcagccccggtgggaggctgcggaccatggggactcagctctgcatggcaggcagaggcccagggacactgacgtgcatgagcttgctgctttccagggtgtgttgagggtggccatgggtgacacgtcccactctttctgatggaggggcatccgtggtgccttctagcttagaaccattttccaggtctcttctgggttgggcaggactgatattcccaagctggtggaagatggttcatcttcctcgcacagtgtgggttcttggagttcatccagggaaggcggcgcctctttctcaggtcctgcaggctggtctctgagcctgcccccacgaactttctggattccaaggtgggatggtgatccctttgacccctgcagaccctctacttgcgaaaagcagcattgaagcagccttttcccattgtagaagggacagggagtcagatcccctcaaccccccggcttcagggaccccagaagtgccttccaagcttcccccaagatccacatcacccacgaccctgccactgtttttgctgtgttcaccacatctctgatcctgaagtgaattctggaactatggaccacattagactgggcagagattcgcccaacccctagcactccggctctgggctttcggccagaagttaattaacctcagagccaggagcctggggctggggcctccctcccaggccctgtttagctgtttagctggttgtgttttaagcaagttcttgcccaatcatgcatcctgctagaaaaggaaatgaagcaacgttcccagccaccgcaggcagttgtcggcgactttctgatgtaagcacctgggctccgacttgaggggggcccttcaagacccaatgtccatttcccaatccttgtcatcggcagggcccagggatgtgacaatttttgctaatggaggagtcacttctttttttttttttttctttttgagatggtctggctctgtcacccaggctggagtgcagtggtgcaatcatagctcaccacagcctcaaactaggggtcacttctaagggatgctgggggttgggcggaaggggtgaggaggtaggattgagtaacttgctgtcactgcttgtactttgtagacagcctgagagtggcaggaccttatgtgaatgggggggatggactgtgatcagtgccggggagtctctgaagctggggtccccacctccaggggcttctgctcagaggttacgtgtgcagtttgaagatgtacatcttgacctccggtttagaggcactttctgcccatcagattccaaactctaggggcgcagcaccttttctttgctcccaaacaccaaccaacaccccttcacaggaccagcactgttaggatggctaagtggatgttttatgttcccacgtccctgactctgtttcagaggttgtgtctgctctcccagcccctgaagccaaaatgacttcctgcagctttcatgagctcagcctcttccctggggtatgtgtgagggggaaagcctggttcaagtttagatttatttctagggagccctggtttcttcataccagaggctacccttagaactttggagtggggtatctttttttcatttgtttttttgatacagagtctcgctctattgcccaggctggagtgcggtggcacaatctcagcttactgcaacctccacctccagggttcaagcgattctcctgcctcagcctcccgagtagctggcattacaggcacctgccaccacacccggctaaattttgtatttttagtagagaaggggtttcaccatgttggtgaggcttgtctcaaactgacttcaagtgatccacttgcttcggcctcccaaagtgctgggattacaggcgtgagccatcacgcccagccgagggtatcttttataccaacaaattagatgactgaggtgtaatggacaaatcctatgcacaaagtgagggtatctgaatatgtgggcgggagtcaaaaatttttagctactttaacactaaagtcaaactaaagtagcttcaaaaagacttctcaagatgcagtatggcctgctgaggtttttttgttttttttttttttaagacagagagtcgctcgtcgcccaggccgcagtgcagtagcatgatctcagctcactgcaacctccacctcccgggttcaagcgattctcctgtctcagcctcctaagtagctgggactacaggcacctgccaccacgcccatctaagttttgcatttttagtagcgacggtttcaccttgttggccaggctggttttgttggccaattgtctctaaactgctgtcaaaaaaaggaatggatcagattgtcttgaatagggcagagctaacctgtaatcacctgtgtgatgagaaacagctttgactgcattttactcctgacctggcctaagctttctgtttacataagatttttcaagaattcaacttcaagtagcagccgagagagctgcctcaggattctctcaaaaactgggaataatatgggaacatttgtttcttctaaaaataaggcaaatgttacattgaatgatttggggggtgaggtttaattggaaatggtctctggggactgaaaactgatgtttttgcagattacctcagggaaacggaggtttgttgagtttacagacacattaaaccaaaggccgtgggaaaacccctctccagctccaggggattggtcaggaccacccactaaccagtgccttccttcttaacattcacttttagcagcttgtgtttattttacatgggcagttttgatgggaaattgccatgaccacaggggtttggagttctgctttttttttttcttcttctttttcgggggactgggggactcctcccaagatcacattttagcatctttctctcctactccatttagaaaaataagtaacaggtgaaatgtggtctcagtgttaacgggataattctgctaccggctcctccctgatgattctgaaatacactactgaacgagctctggctggtcctttctatcctggatgtggttcttctgtgtagcaattccttgatgtccagtttggaaagatgtactcttctcaacaagaaaaacttaaatccgtcgtgcccaaatatagttgtgcttttatttcca

SEQ ID NO: 173232 - DNA, 924 bp, Homo sapiens
  Payload ID: 14049
  Gene Symbol: RAB3D
  Gene Name: RAB3D, member RAS oncogene family
  Uniprot ID: O95716
  ENST ID: ENST00000589655
  CDS Start-End: 206-865
gggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggacgcccgtctcctctccctgaggatttcaggtctccctgtcccaggaggcttgtgccaagatggcatcagctggagacacccaggcaggcccacgggatgcagcagatcagaacttcgactatatgttcaaactgctactgataggcaacagcagtgtgggcaagacttccttcctgttccgatacgcggacgactccttcactcccgccttcgtcagtactgtgggcatcgatttcaaggtcaagaccgtctaccgccatgacaagaggatcaagctgcagatctgggacacagcgggccaggagcgctaccgcaccatcaccacggcctactaccggggagccatgggcttcctgctcatgtatgacatcgccaatcaggaatcctttgccgctgtgcaggactgggccacgcaaatcaagacctactcctgggacaacgcccaggtcatcctggtggggaacaagtgtgacctggaggacgaacgtgttgtgcctgctgaggatggccggaggctcgccgacgaccttggtttcgagttctttgaagccagtgccaaggagaacatcaatgtgaagcaggtcttcgagcgcctggtggatgtcatctgcgagaagatgaacgagtccctggaacccagctccagctcaggcagcaacgggaaaggcccggccgtgggggatgctccagccccccagcccagcagctgcagctgctagagatggcccccaaccccccacccacccctctcctgcctcggcagggactgtgatcgagg

SEQ ID NO: 173233 - DNA, 1345 bp, Homo sapiens
  Payload ID: 14050
  Gene Symbol: RAB40A
  Gene Name: RAB40A, member RAS oncogene family
  Uniprot ID: Q8WXH6
  ENST ID: ENST00000304236
  CDS Start-End: 343-1176
ccaaacatggatcctcatgattttattttctagattggctgataggctgaataatctcctgtagggtaagaagtgtcaactgtatcaagcacatggaggtggactggctacaggagaaagtgtgacgtgggtgaaggagttcttattgagccatgggaggaagaaatagtacagaagagcaaagaataataatgagtcagctagacagaagacaggagtcatcagatttgtaccctagttactcgacccatcaactgactgtggtttttgggaacaggcccggcaccacctctgcgcacaaccccgcgggcctggctcaggcgggagtgcggggccagcaccatgagcgccccgggcagccccgaccaggcctatgacttcctgctcaagttcctgctggtgggcgacagggacgtaggcaagagtgagatcctggagagcctgcaggatggtgcagctgagtccccgtacagccatctcggggggatcgactacaagacgaccaccatcctgctggacggccagcgggtgaagctgaagctctgggatacgtcggggcagggaagattttgtaccatattccgctcctactctcgtggtgcacaaggagtgatcctggtctacgacattgcaaaccgctggtctttcgagggtatggatcgatggattaagaagattgaggaacatgcccctggtgtccctaaaatcctggtggggaatcgcctacatctggcattcaagaggcaggtgcccagggagcaggcccaggcctacgccgagcgcctgggtgtgaccttctttgaggtcagccctctgtgcaatttcaacatcatagagtctttcacggagctggccaggatagtgctgctgcggcacaggatgaattggctcgggaggccgagcaaggtactgagcttgcaagacctctgctgccgcaccatcgtgtcctgcacacctgtgcatctggtggacaagctcccgctccccagtaccttaagaagccacctcaagtccttctccatggctaagggcctgaatgccaggatgatgcgaggcctctcctactccctcaccaccagctccactcacaagagcagcctctgcaaagtggagatcgtctgcccaccccagagcccacccaaaaactgcaccagaaacagctgcaaaatttcttaaggaaggcaccaaaaggaaacaagctggaatcgctccaggaaaaactctggttacacctggaagatggaagtcgcattgtagattcaagaaattagttttcagtttctcacgggaaccatgctgcttgggaatgtgtgtgatgccttctgtcaataaaaacacattacac

SEQ ID NO: 173234 - DNA, 3126 bp, Homo sapiens
  Payload ID: 14050
  Gene Symbol: RAB40A
  Gene Name: RAB40A, member RAS oncogene family
  Uniprot ID: Q8WXH6
  ENST ID: ENST00000372633
  CDS Start-End: 2120-2953
atactctcaacaggttttctcatttgctccttgggacagctcggtaaggatgatacagtcagttctatctcacagataatcaagctcaggctttcagagcctaagtcaccttcccaggtaagtggcaggattggaatgaggtttcatccctcaccctccctaaaggaccctgagcacccccttttagaagatgggcttccagggcttgagaaatgtcagattccactcccctgctattgtggccccatgggtcccccactccacaacccctctgggtgatgaggaagacagaagtgaaatcctgcactttatgccaagagactgggtgtgggaccgtatgagttggctgatcccttaagtggtgagtgggctcaggcagaagcttaggtgttggccttgggacaggtgagctgaagagaaggaaagtaacctgcactgaactactttaggcaaatgcactctatatttcatctcctttatcctaacggctgttcaaggtaccgatgattatgatcattattccaatcagggtgctgtctttaagggagtttgtgtaaatcagggagagaactttattatctccttattgtcagctaaatctggaattaatctaaaggttttttttttctctatttgccctgaagcccacagagaaatagaaatgtttttcttatcctttattcacgtttgttctgtattgatgagtatttagaatgtttctcattttttcctttttaaaaagatttcagcaatgctatttcaaataaccacttacctggctattttggacatgtgaaaattttttcctccattacatttgtaaacatctatcccttggggcttgatttcaataatttaaactcccttatatgtgtatgagcattctcatttctttaaccatctttgtacctgttgtagttacaatatttaagtgtatttataactgataagtgtgtttccatttccttgatgtatttggtccctcatcctgcccccatacacagacacacacagagcctttttcttttgcatctttttcttttgcaaattaaaaaaaaattctttttcggtttttttctacatttaaattttgtcagatgataggtgataaaaggatatttagatggtttcattagcattctttaatgtattagtgagctagaatgcattttcttgtgattactggccatttgcgtttcttcacctgtgaaccatatacatattttttcagttttgttattttgttataggagctgtacatgtgttaaacctaaaacccttcactgatggatgcatgcattatttcaacacatctttgttgggtgaatattatttatgagacactctagcaaaatccatgtcctagatatctcttctgagatcttggctcttatatttatgggagatgtccccctgcagcaagaaaagtattagtgcccatgtaaacatgcgtggcttgtcaaggatcacatgcacagacagttcacacttactcctaaacccggcatggccacagagtagaaagggtgtgtagtgcgttatatgaggagagcactggctcaggattgtgatttctgtgatctctatattaatggcaatgttttaaaaaattacataacatttctgagtttgccttttctcatttgtaaaatggaaacaattatagctaccaaagacaactgttctgaaagcaaaagaacaaaatattttaagcgtcatacacagcatagggtacgtacagtactcaacacatcttagtccctttcctatcccatacccgtccttcctttaaaggagattcctttgacataatccaaaaggcatggttccataacgatcacatgaaagttttaagggaaatgtataggtttccatgatgaattaactgctgtgtcactactctgtgctgggtaagaaaaaggaaaacaatcgctgaatcagtttcctagggtttgtaaaagaaatccatcaaagccaccacctcatttcgctttatttcacagacttccccatctcattttttatgttctatgctaatttctcaagaagaacaggcccggcaccacctctgcgcacaaccccgcgggcctggctcaggcgggagtgcggggccagcaccatgagcgccccgggcagccccgaccaggcctatgacttcctgctcaagttcctgctggtgggcgacagggacgtaggcaagagtgagatcctggagagcctgcaggatggtgcagctgagtccccgtacagccatctcggggggatcgactacaagacgaccaccatcctgctggacggccagcgggtgaagctgaagctctgggatacgtcggggcagggaagattttgtaccatattccgctcctactctcgtggtgcacaaggagtgatcctggtctacgacattgcaaaccgctggtctttcgagggtatggatcgatggattaagaagattgaggaacatgcccctggtgtccctaaaatcctggtggggaatcgcctacatctggcattcaagaggcaggtgcccagggagcaggcccaggcctacgccgagcgcctgggtgtgaccttctttgaggtcagccctctgtgcaatttcaacatcatagagtctttcacggagctggccaggatagtgctgctgcggcacaggatgaattggctcgggaggccgagcaaggtactgagcttgcaagacctctgctgccgcaccatcgtgtcctgcacacctgtgcatctggtggacaagctcccgctccccagtaccttaagaagccacctcaagtccttctccatggctaagggcctgaatgccaggatgatgcgaggcctctcctactccctcaccaccagctccactcacaagagcagcctctgcaaagtggagatcgtctgcccaccccagagcccacccaaaaactgcaccagaaacagctgcaaaatttcttaaggaaggcaccaaaaggaaacaagctggaatcgctccaggaaaaactctggttacacctggaagatggaagtcgcattgtagattcaagaaattagttttcagtttctcacgggaaccatgctgcttgggaatgtgtgtgatgccttctgtcaataaaaacacattacacagtt

SEQ ID NO: 173235 - DNA, 1713 bp, Homo sapiens
  Payload ID: 14051
  Gene Symbol: RAB40AL
  Gene Name: RAB40A, member RAS oncogene family-like
  Uniprot ID: P0C0E4
  ENST ID: ENST00000218249
  CDS Start-End: 70-906
aataggcccggcaccgcctctgcgcacaaccttgctggtctggcccaggcggggggcggggccagcacgatgagcgccccgggcagccccgaccaggcctacgacttcctgctcaagttcctgctggtgggcgacagggacgtaggcaagagtgagatcctggagagcctgcaggacggcacggccgagtccccgtacagtcacctggggggaatcgactacaagacgaccaccatcctgctggacggccagcgggtgaagctgaagctctgggatacgtcggggcagggaagattttgtaccatattccgctcctactctcgtggtgcacaaggagtgatcctggtctacgacattgcaaaccgctggtctttcgagggtatggatcgatggattaagaagattgaggaacatgcccctggtgtccctaaaatcctggtggggaatcgcctacatctggcattcaagaggcaggtgcccagggagcaggcccaggcctacgccgagcgcctgggcgtgaccttctttgaggtcagccctctgtgcaatttcaacatcatagagtctttcacggagctggccaggatagtgctgctgcggcacaggttgaactggctcgggaggccgagcaaggtactgagcttgcaagacctctgctgccgcaccatcgtgtcctgcacacctgtgcatctggtggacaagctcccgctccccattgccttaagaagccacctcaagtccttctccatggctaagggcctgaatgccaggatgatgcgaggcctctcctactccctcaccaccagctccactcacaaaaggagcagcctctgcaaagtgaagatcgtctgcccaccccagagcccacccaaaaactgcaccagaaacagctgcaaaatttcttaaggaaggcaccaaaaggaaacaagctggaatcgctccaggaaaaactctgaatggttacacctggaagagggaagatgcattctagattcaaagaaatacgttttcagtttctcatgggaacaatgctgcttgggaatgtgtgtgatgccttctgtcaataaaagcactttacgcagtttgactttgaatttctacgtggatgtgcatgtgtttataaaggggaaattagtactctgcttaactcttgataacatgaaattttgaatgttacttatatcataatcacactgcatctttttccttaaaataaccgcttttgtaagaatggtgatatgacagtgatgagtataaattcaagggaatttgagatgcaatgatagtgagatcattccgagtcattgatattactagaggggactttttgtaaacctcctttttgatgtcaaagcaccaatttataaaacactgcagatgcatatagagattatacgtaacagatctgtccagtttgtgcacgaaatggatttgataaagtttttgctatgttattttactacatttggagattaataagtgatttatatgtatgtttttctgtaaatctacttttttgtacaagatgttctacaagatatgaagctaagggaggaaaacgccaaagatatctctagttatgttgaacatagccaacatggtttcaatgggtcagtaagaaaaaagccatttcagtaaggaatgaaataagtacttatttatgaaaatgtttcttaacaataaaaaagtatatatttttatcttttggtaaaa

SEQ ID NO: 173236 - DNA, 2189 bp, Homo sapiens
  Payload ID: 14052
  Gene Symbol: RAB40B
  Gene Name: RAB40B, member RAS oncogene family
  ENST ID: ENST00000269347
  CDS Start-End: 1094-1393
cggggcccgcgcggcgcctctcggggccgggccgccgcctctgcgctcagccccgcaggccgggcatgggtgggggcgccgggccgtcacgatgagcgccctgggcagcccggtccgggcctacgactttctgctcaagttcctgctggtgggcgacagcgacgtgggcaagggcgagatcctggcgagcctgcaggatggcgcggccgagtccccgtacggccacccggcggatagttcggatgtcgctgtggcaaagtccgagggccagcgctgccctggagattgagcgcctggaggacagggctggagattgagcgcctggaggacagggctggagattgagcgcctggaggacagggctggagattgagcgcctggaggacagggctggagattgagcgcctggaggacagggctggagattgagcgcctggaggacagggctggagattgagcgcctggaggacagggctggagattgagcgcctggaggacagggctggagattgagcgcctggaggacagggctttgtctgcactgtgccctcggggtctgggctcagtgagggatgaaccctaccagagctacaggaataaagcacccaacaacgtgtacgcccagacgaatatggcgctttaagagctgtgcgtgttttgggggagcagacggttgacagtgttgagtttgattgaaggcatcgactacaagacgaccaccatcctgctggacgggcggcgggtgaagctgcagctctgggatacttcaggccagggaagattttgtaccatattccgctcctactcccggggcgcacagggtgtgatcctggtctatgacattgcgaaccgctggtcttttgacggcattgatcgatggattaaggagatcgatgagcatgcccccggagtccccaagatcctggtggggaaccgcctgcacctggcgttcaagcggcaggtgcccacggagcaggcccaggcctacgccgagcgcctgggcgtgaccttctttgaggtcagccctctgtgcaatttcaacatcacagagtcgttcacggagctggccaggatcgtgctgctgcggcatgggatggaccggctctggcggccgagcaaggtgctgagcttgcaagacctctgctgccgggcggtcgtgtcctgcacgccggtgcacctggtggacaagctcccgctccccattgccttaagaagccacctcaagtccttctcgatggccaacggcctgaatgccaggatgatgcacggcggttcctactccctcaccaccagctccacccacaaaaggagcagcctccgcaaagtgaagctcgtccgccccccccagagcccccccaaaaactgcaccagaaacagctgcaaaatttcttaaggaaggcactgaaagaaacacggcggaatctctccaggagaagctcggcgttacccccggcagctggtggatgcatctcagatcccggttcctctcggcgaatgctgcttgcgaatgtgtgcgacgccttccgtgtgatggaaacacactaccccgtcggacttcgaatttctacgtggatgtgcatgaagctcttgttttcgatgtgtgtttgtaaagggaaaattagtactctgctcgactcttggtaacatgaaattctgaatgttactttatcatgattgcactgcaactttttccttaaaataactgcttttgtaagaacggtgatattggagtgattagtataaattcaatggaatttgagaagcaatggcagcgggataatttagagtcactgatattacgagaggggtctttttgtaaacctccttttcaatgtcaaagcgccaatttataaaacgctgcagatgtagaggttatgtgcaactgatctgtccagtttgtgtatgaaatggatttgataaagtttttgctagttatttactacattttgggattaataagtgatttatatgcatatttttctgtaaatctacagttttttgtacaagatattctacaagttatgaagctaagggaagaaaatgccaaagatacctctagttatgttgaacacagccagcacagtttcgacatgtcaaggaagagctgtttcagtaaagaatgaagtgaaaacacttatttaggaaaatgtttctcaacaataaaatgtatagttgtttctctcttggta

SEQ ID NO: 173237 - DNA, 704 bp, Homo sapiens
  Payload ID: 14052
  Gene Symbol: RAB40B
  Gene Name: RAB40B, member RAS oncogene family
  ENST ID: ENST00000538809
  CDS Start-End: 67-486
gccgggccgccgcctctgcgctcagccccgcaggccgggcatgggtgggggcgccgggccgtcacgatgagcgccctgggcagcccggtccgggcctacgactttctgctcaagttcctgctggtgggcgacagcgacgtgggcaagggcgagatcctggcgagcctgcaggatggcgcggccgagtccccgtacggccacccggcgggcatcgactacaagacgaccaccatcctgctggacgggcggcgggtgaagctgcagctctgggatacttcaggccagggaagattttgtaccatattccgctcctactcccggggcgcacagggtgtgatcctggtctatgacattgcgaaccgctggtcttttgacggcattgatcgatggattaaggagatcgatgagagtcgttcacggagctggccaggatcgtgctgctgcggcatgggatggaccggctctggcggccgagcaaggtgctgagcttgcaagacctctgctgccgggcggtcgtgtcctgcacgccggtgcacctggtggacaagctcccgctccccattgccttaagaagccacctcaagtccttctcgatggccaacggcctgaatgccaggatgatgcacggcggttcctactccctcaccaccagctccacccacaaaaggagcagcctccgcaaagtgaagctcgtccgccccccc

SEQ ID NO: 173238 - DNA, 343 bp, Homo sapiens
  Payload ID: 14052
  Gene Symbol: RAB40B
  Gene Name: RAB40B, member RAS oncogene family
  ENST ID: ENST00000576148
  CDS Start-End: 1-129
ggaagattttgtaccatattccgctcctactcccggggcgcacagggtgtgatcctggtctatgacattgcgaaccgctggtcttttgacggcattgatcgatggattaaggagatcgatgagtgctgagcttgcaagacctctgctgccgggcggtcgtgtcctgcacgccggtgcacctggtggacaagctcccgctccccattgccttaagaagccacctcaagtccttctcgatggccaacggcctgaatgccaggatgatgcacggcggttcctactccctcaccaccagctccacccacaaaaggagcagcctccgcaaagtgaagctcgtccgccc

SEQ ID NO: 173239 - DNA, 3859 bp, Homo sapiens
  Payload ID: 14052
  Gene Symbol: RAB40B
  Gene Name: RAB40B, member RAS oncogene family
  Uniprot ID: Q12829
  ENST ID: ENST00000571995
  CDS Start-End: 133-969
agcgctgggcggcggggcggggccggaggcgagcaaggactcggggcccgcgcggcgcctctcggggccgggccgccgcctctgcgctcagccccgcaggccgggcatgggtgggggcgccgggccgtcacgatgagcgccctgggcagcccggtccgggcctacgactttctgctcaagttcctgctggtgggcgacagcgacgtgggcaagggcgagatcctggcgagcctgcaggatggcgcggccgagtccccgtacggccacccggcgggcatcgactacaagacgaccaccatcctgctggacgggcggcgggtgaagctgcagctctgggatacttcaggccagggaagattttgtaccatattccgctcctactcccggggcgcacagggtgtgatcctggtctatgacattgcgaaccgctggtcttttgacggcattgatcgatggattaaggagatcgatgagcatgcccccggagtccccaagatcctggtggggaaccgcctgcacctggcgttcaagcggcaggtgcccacggagcaggcccaggcctacgccgagcgcctgggcgtgaccttctttgaggtcagccctctgtgcaatttcaacatcacagagtcgttcacggagctggccaggatcgtgctgctgcggcatgggatggaccggctctggcggccgagcaaggtgctgagcttgcaagacctctgctgccgggcggtcgtgtcctgcacgccggtgcacctggtggacaagctcccgctccccattgccttaagaagccacctcaagtccttctcgatggccaacggcctgaatgccaggatgatgcacggcggttcctactccctcaccaccagctccacccacaaaaggagcagcctccgcaaagtgaagctcgtccgccccccccagagcccccccaaaaactgcaccagaaacagctgcaaaatttcttaaggaaggcactgaaagaaacacggcggaatctctccaggagaagctcggcgttacccccggcagctggtggatgcatctcagatcccggttcctctcggcgaatgctgcttgcgaatgtgtgcgacgccttccgtgtgatggaaacacactaccccgtcggacttcgaatttctacgtggatgtgcatgaagctcttgttttcgatgtgtgtttgtaaagggaaaattagtactctgctcgactcttggtaacatgaaattctgaatgttactttatcatgattgcactgcaactttttccttaaaataactgcttttgtaagaacggtgatattggagtgattagtataaattcaatggaatttgagaagcaatggcagcgggataatttagagtcactgatattacgagaggggtctttttgtaaacctccttttcaatgtcaaagcgccaatttataaaacgctgcagatgtagaggttatgtgcaactgatctgtccagtttgtgtatgaaatggatttgataaagtttttgctagttatttactacattttgggattaataagtgatttatatgcatatttttctgtaaatctacagttttttgtacaagatattctacaagttatgaagctaagggaagaaaatgccaaagatacctctagttatgttgaacacagccagcacagtttcgacatgtcaaggaagagctgtttcagtaaagaatgaagtgaaaacacttatttaggaaaatgtttctcaacaataaaatgtatagttgtttctctcttggtagagttggcgaccggttctttcgaattttgtatttatttatttatttatttttgagacagagtttcgctcttgttgcccagggtggagtacaatggcacgatctgggctcaccacaacctccgcctcccgggttcaagcgattctcctgcctcagcctcccgagtagctgggattacagaggtgcaccaccacgcccggctaatttttgtatttttagtagagatggggtttcaccatgttggtcaggctggtgttgaactcctaacctcaggtgatccacccaccttggcctcccaaagtgctgggattacaggcgtgagccactgcgcccggccagattttgtgtatttcttatagccctttacttcactgcgccactgcctggtgtagacatcacatatcggagctaatacacgacactggcaacaaggctgaatccttgaactgttgtcgcctgttgagaaaggattccttttccggaacagaagtgcagaggaggagagagcggagagttaaaagctggcacccaggcatgtgcctgtctgagaaatcagagccgtgctcctgagcctcggtgaggagctccgaggggctgtcaggaattccgcatgaagatgtagcccctgaccccgactgcctcagagcagggctgaccgcaaagacctccagggccgctctcttccctggtcacactgttgaacgtttctctgtggctgggggtcgcaaatgagggactaaaccaaaaaaacgaagcgagaaaatacccagatgttcctagttcctgctgatgatctgtagattcttagaaacttaagggacccagctgggtgtgatggctcacacctgtaatcccagcacttcaggaggccgaggcagccggatcagaggtcaggagttcaagaccagtctggccaacgtgatgaaaccccgtctctaataaaattacaaaaattggcttggcatggcagcgcacacctgtaatcccagctactcaggaggctgaagcaggagaatcacttgaacctgggaggcaggggttgcagtgagccgagatcgtaccactgcaccccagcctgggcgacaagtgaaactccatctaaaaaaaaaaaaaaaaaagaaatttaagggaccctagaatcaggggcaaagcctgtattcagagatggtggaaccgaggcccagacaggagagaggagcactggtccctgcgggtggacccaggcttgggggtgtctggccacctgggcacggcagccacggggacaaagtccacggggaggcaggggtgtggtctgtgggcagaaggtgaaccctgaggggacagtgtctggagagggtggccagcctcgtgcaggcacgctgcaaagacctgtgcacccttctctctgctgtgccacaggtggggtgagaacgacagggccgacctcccagctgcaaacacaaggacactgagatgcacagaaaggagagtccacgttgaagaaacccacgttgaggggcctcttctccctccgttcccagctcgctgatggtgaagggtaaggaaatggatcctcccattgcaacattaaaccaggccaaacctgtatttttctcttccttcctttttcttgttttgtaattgatgtctcctcgggactactgataatgtcctagaaagaataaaataaagtttcccaaggctttgtgactcagagctctttggaggtgttcaccgaatgcacgggccgcccggaggccttggccctccagggaaacaccaccagaagtccccagaagcggaacatgtagcaaggaggctccccgagatctcccagagggagcacagccctgccaagttattggttttggacttccggcttccagagctacgagaaaataaatatttgttatttaagtcaccaggtttgtggcgattgttacggcagcctcaggaaactcctacaaggaagtgagttacgctcacggcagaaagtgctacagcaaaccaaggcagaacaaaaacagacgaaacctaatacagaccggactaagtagaagactgtgtgtttgggtggtgaatatacaaaaaacataaatataaattaaacctta

SEQ ID NO: 173240 - DNA, 2699 bp, Homo sapiens
  Payload ID: 14053
  Gene Symbol: RAB40C
  Gene Name: RAB40C, member RAS oncogene family
  Uniprot ID: Q96S21
  ENST ID: ENST00000248139
  CDS Start-End: 204-1049
cgggaagcggcggggcggcggcgaggctgaggtgcgcccgggcgcgggcggggcggggccggcgctgggcttcgggcgcgcccactcggccgccgtggggcggacgcaacgggcgcaggtgcggggcgcgggctctctcacgccgcggcctcacccggcggtgcttcggcaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggatgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtcccca

SEQ ID NO: 173241 - DNA, 2569 bp, Homo sapiens
  Payload ID: 14053
  Gene Symbol: RAB40C
  Gene Name: RAB40C, member RAS oncogene family
  Uniprot ID: Q96S21
  ENST ID: ENST00000538492
  CDS Start-End: 75-920
gccctggtggtgcgggaagcggcggggcggcggcgaggctgaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggatgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtcccc

SEQ ID NO: 173242 - DNA, 2717 bp, Homo sapiens
  Payload ID: 14053
  Gene Symbol: RAB40C
  Gene Name: RAB40C, member RAS oncogene family
  Uniprot ID: Q96S21
  ENST ID: ENST00000535977
  CDS Start-End: 223-1068
cgcccggggccaccccgccgctccctccgagggttctgcggaagcaggcggcacagcctgcgaggggctttcgtttcccggactcagccgcatcgcctcggctcgggcgcgcctgcatcctgccgcccgtccgcgcgttgaaggggcggatacaaacaacgtggacttccgagcccctgattggcgagcgtgcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggatgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtcccc

SEQ ID NO: 173243 - DNA, 2609 bp, Homo sapiens
  Payload ID: 14053
  Gene Symbol: RAB40C
  Gene Name: RAB40C, member RAS oncogene family
  Uniprot ID: Q96S21
  ENST ID: ENST00000539661
  CDS Start-End: 115-960
ggatttctctgggaggcagccgcagggaagggaatgatcttggtgaacttataatcgaaccaatggttccgggaaagcaggaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagccccccccagaactgctcgcggagtaactgcaagatctcctagcggggatgggcggggccgcctgtgcagatgccaggagggctcgagctggacactcctggctggacgccaggccagtgccgcctacgtggagactgtccacacagctgcctcagaagcgccgggctttcctcacacctgagccgggtgcgaggaggagcatgcacggaccaagcgcggcaggcgggaggagggggcgcggctgggctgctggtgcttccgggaatcttggtcggaaacaagccgggcctccccagctgcctgggcttgaccggcggggagcctggttggcctttcttatttatatagagaacacttcacttttttgtacatttttaaggggccttcagggaagcctgggtgtggcccggtggtggtgcactggtgacttcatggccacgccagctgcggggacgcacttgggactcctcgagaggggactcgcggccgcgatggcaaggcatcctgtgaattcatgcgctgcgagtggcggggctgcccagaggccgggggagcagacagggccggtgctccctctggaagcttgggtgaccggggccctggctcccacgggatggagggtgtggtcctgtggtcagagcccaagcagcactcaggagaggggagaaaggaggtgcacctggcagcccacatttttgttgctccccaaatccctccccacgtggggatgagaaccttcctgctgtgatgtgacaccttcggggacattgaccactcaaaactcagatcatctcgcccaccctggagagtgcagagctatctgtagacttaggaatacttgatgggcagcggtgcagaccccgggcacctgcgtgcagcctcctgttctcggcagcttctgtcgctggccctggggtccccacagctgcagctctcctgtgaggttgcacggcatcagaaccatcctgaccttcttagggacgtgcctggaaccacctcgtccacgtccacgtccacctgggggcctcgggaggctaggcccctcctcaaaggcccaccagcccggcgctcatgctgagccccaggcacgcagggccggccacctctctcctgaagccattggccgctcctccacccagtgcttctgcccatgcctgccccagcagcccctctgcacggtcaccatcgcctgggcctgcccacagcactggtgctcacctctacctcctgtcctcaggccgtgcggcacgacatggccagcacgcagaaggagccctcccgggacccaggaccccccgtggtggactccgcggcacatgcttcccaaggtggtcccacggagggtgttactgggcaccagtggactcgccccatggcccgttcctgggagatgagggccgtggcctgcatgaactaccagatgagtaagggaaccccaggcaggcggccctgccacagcccccaaagacactggcctcctgctccagcttccctgtcctggccccacctgtcctgttgctgccagcagggcccttgtttgggattatgaacaaacctcacagactttgaggacctggatggtcctgcattcacggcatcaacactacccgcgctgctgttagacactccgccattcctggttctctccgaaccgttctttgtacagtaaatgtaattcagctgtggtcccc

SEQ ID NO: 173244 - DNA, 692 bp, Homo sapiens
  Payload ID: 14053
  Gene Symbol: RAB40C
  Gene Name: RAB40C, member RAS oncogene family
  ENST ID: ENST00000569575
  CDS Start-End: 223-692
cgcccggggccaccccgccgctccctccgagggttctgcggaagcaggcggcacagcctgcgaggggctttcgtttcccggactcagccgcatcgcctcggctcgggcgcgcctgcatcctgccgcccgtccgcgcgttgaaggggcggatacaaacaacgtggacttccgagcccctgattggcgagcgtgcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccc

SEQ ID NO: 173245 - DNA, 921 bp, Homo sapiens
  Payload ID: 14053
  Gene Symbol: RAB40C
  Gene Name: RAB40C, member RAS oncogene family
  ENST ID: ENST00000564703
  CDS Start-End: 808-921
gcatttttaaacttgtttggccctccctaacaccaaccttggcagttcctgggctgcagtaagccgagacttggaaatacattcgccttggagaattcaacttcaaaatgcatacgaagtaggtcagggtggaaataaaggcactgccctttctccaggcacgctggagtccacgccctgcctttgcccaatgccctctgagggagaggccctgtgccttgcacccagcgcgggccacaggcggaggccccattccaggcaagccgtgcccatggagaggctggcctgctaggctgtggggcccgatggcctgacactgtatggaccacgctcctgccctgccctgccccgccctgcccgtggcccgtgtgcagaagtgggcaggcctgggttgctgggccagagccccgagatttccccctgccccactggctgagtgtgggggagctgcttctccacttccgcgtgggtcttggccctgggaggccagtggccgaggctggtctcgcgggcgctcgctccaggagtggcgcgtcccctcagcgccctgtgcttcctcgcagggatcgactacaagaccaccaccatcctgctggacggccggcgcgtgaagctggagctctggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaac

SEQ ID NO: 173246 - DNA, 753 bp, Homo sapiens
  Payload ID: 14053
  Gene Symbol: RAB40C
  Gene Name: RAB40C, member RAS oncogene family
  ENST ID: ENST00000566290
  CDS Start-End: 115-753
ggatttctctgggaggcagccgcagggaagggaatgatcttggtgaacttataatcgaaccaatggttccgggaaagcaggaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttcca

SEQ ID NO: 173247 - DNA, 710 bp, Homo sapiens
  Payload ID: 14053
  Gene Symbol: RAB40C
  Gene Name: RAB40C, member RAS oncogene family
  ENST ID: ENST00000563109
  CDS Start-End: 1-710
tgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgagtgttcagcctgcaggacctctgctgccgggccatcgtctcctgcacccccgtgcacctcatcgacaagcttccactgcccgtcaccatcaagagccacctcaagtccttctcgatggccaacggcatgaacgcggtcatgatgcacggccgttcctactccctggccagcggggccgggggcggcggcagcaagggcaacagcctcaagaggtccaagtccatccgtccaccccagagcccc

SEQ ID NO: 173248 - DNA, 565 bp, Homo sapiens
  Payload ID: 14053
  Gene Symbol: RAB40C
  Gene Name: RAB40C, member RAS oncogene family
  ENST ID: ENST00000509637
  CDS Start-End: 1-149
gctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgattgcagctgagaaggcgcgaagctgctggtccctgaaaagctgccgcctaccctggtctggagcccctgcgagctggcgtagagcaggaaggggttgcatcacagctgagtcctcccctgcgcagcacatgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcaga

SEQ ID NO: 173249 - DNA, 648 bp, Homo sapiens
  Payload ID: 14053
  Gene Symbol: RAB40C
  Gene Name: RAB40C, member RAS oncogene family
  ENST ID: ENST00000568586
  CDS Start-End: 84-648
ggcgcggcggccctggtggtgcgggaagcggcggggcggcggcgaggctgaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcatgcggcacggcatggagaagatctggaggcccaaccgag

SEQ ID NO: 173250 - DNA, 783 bp, Homo sapiens
  Payload ID: 14053
  Gene Symbol: RAB40C
  Gene Name: RAB40C, member RAS oncogene family
  ENST ID: ENST00000565511
  CDS Start-End: 51-443
cccggcggtgcttcggcaggcggccggcgcggggcgcaggcggcgcggccatgggctcgcagggcagtccggtgaagagctacgactacctgctcaagttcctgctggtgggcgacagcgacgtgggcaagggcgagatcctggagagcctgcaggacggcgcggcagagtccccgtacgcctacagtaacgggatcgactacaagaccaccaccatcctgctggacggccggcgcgtgaagctggagctctgggacacgtcgggccagggccggttctgcaccatcttcaggtcctactccaggggcgctcagctctgtcccaggtactcccggggggattcactgatggactggccgagaggacacttagcttccacagctgcacgtcccccggctgccagaaccccgcatctgcctgcccaggaaacttccacaggctgatggctccaggggagggaggggaagcggcatttctgacaccatggaaggcgcccacccccctgctgcagtcctgccaggggatcctcttggtgtatgacatcaccaaccgctggtcctttgacggcatcgaccgctggatcaaggagatcgatgagcatgcacccggagtcccccggatcttggttggaaaccggctgcacctggccttcaagcggcaggtcccgacggagcaggcccgcgcgtacgcagagaagaactgcatgaccttctttgaggtcagccccctgtgcaacttcaacgtcatcgagtccttcacggagctatcccgcatcgtgctcat

SEQ ID NO: 173251 - DNA, 1071 bp, Homo sapiens
  Payload ID: 14054
  Gene Symbol: RAB41
  Gene Name: RAB41, member RAS oncogene family
  Uniprot ID: Q5JT25
  ENST ID: ENST00000276066
  CDS Start-End: 47-712
caggctgagcgttggaagccattttggctgcaacctacctgaagcgatgtctgcctttggtcacgacgaggcctggatggaggccggaggctttggtctggaggctgccgaaagaacggaataccagtctctgtgcaaatctaaactcttattcctgggagagcagagcgggaagacatccatcatcagccgcttcatgtacaacagcttcggctgcgcctgccaggcaactgttggaattgacttcttgtctaagaccatgtacttggaggaccaaatagttcagctgcagctatgggacacagctggccaggagcgctttcacagcctaattcctagctacattcgtgattcaactattgcagtggttgtctatgacattacaaacatcaattcttttaaggagacagataagtgggtagaacacgtgcgagcagaaagaggtgacgatgttgtcatcatgttgttgggtaacaagattgatttggataacaaaagacaagtcactgcagaacagggtgaagaaaaatccagaaacctcaatgtgatgtttattgagaccagtgccaaaaccggttacaacgtgaaaaagctgttccggcgtgtggcttctgcccttctttccacaaggacttcacctccaccaaaagaggggacggttgaaatcgaactggaatccttcgaggagtcaggcaacagaagctattgttgacagcttaggctttctctgcctcatttgatggatttcttacatttgggcttgccataccagttctcctccccacctcgttttatgatacatggccacttactctcttccaattcctaggcttggggtaaaaacagaacccctgaaagtgctatcattttttcctgaccgcatctcacagctactgggtggaagcttcttgcagcacctgggaattctaccttaccttctccgacagctaaaagacatctgtagagaatacagttctacagcagctgacatacttcaaaggccaatacaattcattctccactgtttgttgttgtttacctacaccctcaataaatggttctttaacctaa

SEQ ID NO: 173252 - DNA, 1074 bp, Homo sapiens
  Payload ID: 14054
  Gene Symbol: RAB41
  Gene Name: RAB41, member RAS oncogene family
  Uniprot ID: Q5JT25
  ENST ID: ENST00000374473
  CDS Start-End: 47-715
caggctgagcgttggaagccattttggctgcaacctacctgaagcgatgtctgcctttggtcacgacgaggcctggatggaggccggaggctttggtctggaggctgccgaaagaacggaataccagtctctgtgcaaatctaaactcttattcctgggagagcagagcgtagggaagacatccatcatcagccgcttcatgtacaacagcttcggctgcgcctgccaggcaactgttggaattgacttcttgtctaagaccatgtacttggaggaccaaatagttcagctgcagctatgggacacagctggccaggagcgctttcacagcctaattcctagctacattcgtgattcaactattgcagtggttgtctatgacattacaaacatcaattcttttaaggagacagataagtgggtagaacacgtgcgagcagaaagaggtgacgatgttgtcatcatgttgttgggtaacaagattgatttggataacaaaagacaagtcactgcagaacagggtgaagaaaaatccagaaacctcaatgtgatgtttattgagaccagtgccaaaaccggttacaacgtgaaaaagctgttccggcgtgtggcttctgcccttctttccacaaggacttcacctccaccaaaagaggggacggttgaaatcgaactggaatccttcgaggagtcaggcaacagaagctattgttgacagcttaggctttctctgcctcatttgatggatttcttacatttgggcttgccataccagttctcctccccacctcgttttatgatacatggccacttactctcttccaattcctaggcttggggtaaaaacagaacccctgaaagtgctatcattttttcctgaccgcatctcacagctactgggtggaagcttcttgcagcacctgggaattctaccttaccttctccgacagctaaaagacatctgtagagaatacagttctacagcagctgacatacttcaaaggccaatacaattcattctccactgtttgttgttgtttacctacaccctcaataaatggttctttaacctaa

SEQ ID NO: 173253 - DNA, 573 bp, Homo sapiens
  Payload ID: 14054
  Gene Symbol: RAB41
  Gene Name: RAB41, member RAS oncogene family
  ENST ID: ENST00000509895
  CDS Start-End: 470-573
gtggccatgcccaggcctgggtgtgaagccaatggccgtcagccgacgtcagtagagcatggcgtgaagtccggcggctcaggctgagcgttggaagccattttggctgcaacctacctgaagcgatgtctgcctttggtcacgacgaggcctggatggaggccggaggctttggtctggaggctgccgaaagaacggaataccagtctctgtgcaaatctaaactcttattcctgggagagcagagcggtgtgggtctgggttgggctttggggacatggaggtgtaattggtatgaaatggggtggggcattctctggggaaccgagttcctcctcgttgggaaagattggagttggaggaggagggagggctcatagaaactttgaggggagaaagggcactgagggcgacgattggcctgcttatctccctcacagtagggaagacatccatcatcagccgcttcatgtacaacagcttcggctgcgcctgccaggcaactgttggaattgacttcttgtctaagaccatgtacttggaggaccaaatagttcagctgcagctatggga

SEQ ID NO: 173254 - DNA, 1950 bp, Homo sapiens
  Payload ID: 14055
  Gene Symbol: RAB42
  Gene Name: RAB42, member RAS oncogene family
  Uniprot ID: Q8N4Z0
  ENST ID: ENST00000373826
  CDS Start-End: 307-624
aagaaatgagtgaggtggatgcttcagcgctgttagtctcctccccatgcccctcctcacttcatctagtttagtccctttatcctgtgaagtaggggtcatcattagcccccttttacagaggagagaattgaggcttcgagagagagaaacttggccaggagtttccactcggtccgacgccctcggtgccccgccgggtgcatcaccaggtccttttaccggaatgtggtgggtgtcctgctggtctttgatgtgacaaacaggaagtcctttgaacacatccaagactggcaccaggaggtcatggccactcagggcccggacaaggtcatcttcctgctggttggccacaagagtgacctgcagagcacccgctgtgtctcagcccaggaggccgaggagctagctgcctccctgggcatggccttcgtggagacctcggttaaaaacaactgcaatgtggacctggcctttgacaccctcgctgatgctatccagcaggccctgcagcagggggacatcaagctagaagagggctgggggggtgtccggctcatccacaagacccaaatccccaggtcccccagcaggaagcagcactcaggcccatgccagtgttgactctaggagagaaagggttaaagcagtcccagccttagcccacctggtgggatggggagtgttaatatctctctggaggacaaatgacagaagggttcatataaacagtatcctgacacagtcatgcttcctggattttggagtcgaggctttctacagaaaagaaagttctgatggccaggcatggtggctcacgcctgtaatcctagcatttttggaggccaaggacagtggatcacctgaggtcaggggttcgagaccagcctggccaacatggtgaaaccctgtctctactaaaaatacaaaaattagccaggcgtggtggtgcatgcctgtaatcccagttactccagaggctaaggcaggagaattgcttgaacctgggaggcagagattgcagtgagccaagactgcgccactgcactccagcctgggcaacagagtgagactctgtttcaaaaaaaaaaaagaaaagaaaagaaaggcctgagagaccagatgtgcaacttcctgtccttgagcctcagtgtccctatctatcgatggggctcataaaagatcccaccttgaagggaggtggtgaccacaaatgagacagtggacaggatgtgctcacccagagcctgccgcgctgtgaattgaatgacaaaagctctcattcccactccctttttcttggctgcgatgtggccactctggcagcattcctgggctcagacactgagaagccagcgtcaggaagctgatgcatgggcaaaggcaggtgcggggaattccagggggagcttggcttggaggcttcttatgtcctcaggctaaaatgattctgggcatgggattaatatgtgacgtcaaacccagggttgctggccaatgcccccccgaccaggcccaggggctgaaaaatggatgttggaggctgggatgaacatgaatgtgtagcaactatgttgggcacacagtggccactgtgatgagccaccaagatccccctttctggctggggaacccatcaaccctctccccagctgctggagtgccactggatgatggacttcagcttgccccactctctgggaaaggccctcccttcagggcagcttgtatccaaagttcatctcctggggggccttaaaggactccctcttgccccagctctggacaactctgaaagtcaaaaccaactttatcagtctctgtgggcttcattgaggacactgttgtgacatcatagccaagttatccccttgcccaatcctgcttccttttcttccccaaacaggtatccatttcaagaatatcccctaataaacatctgcacactca

SEQ ID NO: 173255 - DNA, 4467 bp, Homo sapiens
  Payload ID: 14056
  Gene Symbol: RAB43
  Gene Name: RAB43, member RAS oncogene family
  Uniprot ID: Q86YS6
  ENST ID: ENST00000315150
  CDS Start-End: 302-940
cggagctgaggaccggccggagctttgcggagggcccggcttggcgggtccgggggggagccgaacccgcggggcaccgggtccgggcggggccgagccgggccggggcgggagccagccggggtggggcggggccgaggccgaggcaggcggtcggcagtgctgggggttcaggtgttgcggcggctccacgtagccaggcggcccgtgggctggagcgggcggagctcggcccgcggcttgcgtgagctcaggccggtcccagcgtccagagcgccggcccttcggcttcttctaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtaggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaggttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccaggggcaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacagggtttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctagcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagagaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataacaagcca

SEQ ID NO: 173256 - DNA, 4230 bp, Homo sapiens
  Payload ID: 14056
  Gene Symbol: RAB43
  Gene Name: RAB43, member RAS oncogene family
  Uniprot ID: Q86YS6
  ENST ID: ENST00000393304
  CDS Start-End: 65-703
agactggtgtggcacggagctgaggaccggccggagctttgcggagggcccggcttggcgggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtaggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaggttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccaggggcaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacagggtttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctagcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagagaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataacaagcca

SEQ ID NO: 173257 - DNA, 4215 bp, Homo sapiens
  Payload ID: 14056
  Gene Symbol: RAB43
  Gene Name: RAB43, member RAS oncogene family
  Uniprot ID: Q86YS6
  ENST ID: ENST00000393305
  CDS Start-End: 50-688
aggcggagtcggggagggctgaggtgggcctgaaggcagagtcgaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtaggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaggttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccaggggcaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacagggtttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctagcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagagaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataacaagcca

SEQ ID NO: 173258 - DNA, 4203 bp, Homo sapiens
  Payload ID: 14056
  Gene Symbol: RAB43
  Gene Name: RAB43, member RAS oncogene family
  Uniprot ID: Q86YS6
  ENST ID: ENST00000393307
  CDS Start-End: 38-676
gggcagagtcgggtcggagtcggggcgcgctgaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtaggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaggttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccaggggcaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacagggtttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctagcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagagaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataacaagcca

SEQ ID NO: 173259 - DNA, 4193 bp, Homo sapiens
  Payload ID: 14056
  Gene Symbol: RAB43
  Gene Name: RAB43, member RAS oncogene family
  Uniprot ID: Q86YS6
  ENST ID: ENST00000393308
  CDS Start-End: 28-666
aggcggaacccgggtcgggctgaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtaggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttctgactttctgtgtagcttctcattttcatcagcacagcatggggtcacggcccacagctaggtggggtcacggcccacagctaggtggggactgtctgctggctcagggcccagtgttttgccactcaggttgcaaaattagctaatccttcagtgccagcactcagaagtctggcaggtgggggaatgagatgagaaagtggacatttaaggtccaagtagaagcttgcatccttgaggctcagggatgagagggcaccgcaaggcacccagccttaccccacaagcaggaatcctgccagccgagcgtgggtcccagtctatggaatcgagtctcccagacaaaaaaggagaggccctggcggtccttggcctggcccattttattccctggacccttaactgcctcaccctgagctgggcaccaaggttagaaggcaaaagtggggtagggggatgtgggaagcagcattgtcctctgggcatgtggctcagaggtatcacagtgacaaaagagccagggctagggctggaggggccaggtgatcttccttagccaatcccagtccgtctgtgtcagcccagctctgcctcgcagccccctcagcatgggtgcccccagaagtaagcagctcttggacccacgagcagggctgcgtcggtttgtggtctagctcccaggggcaggccaggcatggctcagtgcagtccctgggccagtgagaggcctcccccatgcctccctgccctctgcactaagcactttccaggcaggcctggccatagggcaagagcaggccttacagcagtgccacggtgacccaagaggcagggttggggcctggacagggtttcctctgctgagactgagacaagcagggcttgatgctggtggtggagccagcatctcacctgccaggcttccttttgggcagggaggctacctgtggaatggctgagcctggttctgcaggggaggaaggctgccaggagctgaggggctagcacctgcattgaggggagtctgggtgcatcagattggggggcgccagaggcgaggctgcctggctccctttctcagcagctttgcttgtggcaggggtgagagtggagctgagtggggtctgggctctgcccctgcgcctccactgcagtgcctgggctccccttgcagggcagacagtgcctggcactgaggggtgcccccagaccccgctgggactggatgtgccgtgggcagtgccttcctccagcctcacaacctttctgctggggctgaagtttctggggtcacatggtcagaaggggctgagctggtctttcactgcaggcccactctgaaagagaaatcccatgaagcctgtccttgcagagcccctctgtttttgggggaacagggagcattcacagggtcttgggaacaaaggcctgggcctccccgtttgaatttcagccccagttccagggcaagtcccagccacccaagcatacttaccagtactgcccaccaccacccactgcccacctctaagaagcccggctctcctactctgcttccaggctggggcctcacaggtggggctgttaccttcctcagggcttagggagggagggaggacatggacagggccttccaccctggctccttcacagggatggtagctgaccggtgatgggttcatttgtcaccttggactgtgagccacttccacttctcgccccccaggcaggagcaccctcactccaagggcttggcctggaaaggcaggctcacctgggactcaacgttccttcccccgccgccactgtgccccccgtccctccaccccagaagccctgacctcatttgggcaccttgctgtcctctgggcttctcctctgcccaggtcaccctgtggcaggcctgggccctcaggatgtttcaaaggctccacagctccaccgctccacctggcttcactccagcaccctgtccctggagcacctctgtcctgtctgggccaacctggtctccctgccccatgccctcccctggctcttagcaacctgcccttttattcatgccatttggggtcacagatgcctagctggacacagctcccagaactggctccaccctggggccttgcccctagtaccccctggcaggagcaacccaccccatggtcgaggttcccctacccctggatcctggactgaagccatttcctacagagaagcgttcccaccccctctcaggcacaaaagccggtgtccagggactcaagacctgtacctggggttgcaggggctcctgccctgctgtatcccaccaggagggggccccactgcccttccggcccttaaaactgggctgggagagaagacggggaagtgtgtgagacaaaacaaagccggcttgtttcctccccttggcaggctaagctctcccggcagcccgggctctggggcggaaggagaacagtgtcatctcttcctttgttgataaattgccaaagagtgggaacaggtggggtcaggggccagagtgcaggggagggggcaatggtggaggtggcggggggaagcagagggaggtgggctgaggcctcggtggggccagtgcgacgctggcttaaggagctggaggggttcctaatacacatttaattcagtttctcttccctaagaggctgccggagttggggcctcctccagcagagaccctcggacccctgcagggcctggacttggggtgaacagggcttcagtcagcgcaagtattccatttgcatttggtaatttttcatgccacctatttatgaatatataaatctttataccaaatctattttttaaaacatggaaaagttgcctttatggaaacttggcagagccagagtgtacacattcctaaaccattaaacagatttctataacaagcca

SEQ ID NO: 173260 - DNA, 574 bp, Homo sapiens
  Payload ID: 14056
  Gene Symbol: RAB43
  Gene Name: RAB43, member RAS oncogene family
  ENST ID: ENST00000457077
  CDS Start-End: 316-574
ccatcaaatggggccctgggtcctctcctcacaaggattttgggctcctccgcagttttgtagccagcctggattctggccttctgcagcctgctccctcccttcccttccgcccctgggaagagcgacccccaccactctcggagactgcactgcccgcctgtcagagtgggcactcaggtgacactgctgtggtcgtccccttcctccgtgatccattccggagggggtcattcttagtctaggcctgcaggcccggagctccagccatggtctccgcctgtccctgaccggcggtctgggaggcagcaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagct

SEQ ID NO: 173261 - DNA, 1627 bp, Homo sapiens
  Payload ID: 14056
  Gene Symbol: RAB43
  Gene Name: RAB43, member RAS oncogene family
  Uniprot ID: Q86YS6
  ENST ID: ENST00000476465
  CDS Start-End: 293-760
ggaccggccggagctttgcggagggcccggcttggcgggtccgggggggagccgaacccgcggggcaccgggtccgggcggggccgagccgggccggggcgggagccagccggggtggggcggggccgaggccgaggcaggcggtcggcagtgctgggggttcaggtgttgcggcggctccacgtagccaggcggcccgtgggctggagcgggcggagctcggcccgcggcttgcgtgagctcaggccggtcccagcgtccagagcgccggcccttcggcttcttctaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgagatgcagtcctgctatgttgcccaggctgatcttgaactcctggcctcaagcaatcctcctgcctcaacctccaagtagttggaattacaggtggaacaagtcagacctcagcgagcttcgggaggtctccttggctgaggcacagagcctggctgagcactatgacatcctgtgtgccattgagacgtctgccaaggactcgagcaacgtggaggaggccttcctgagggtggccacggagctcatcatgcggcacgggggccccttgttcagcgagaagagccccgaccacatccagctgaacagcaaggacatcggagaaggctggggctgcgggtgctgaccaggggccgggccggcagactgggggttccccacctccttgctctccccagcctgccaagcccagccctccagagccagccctcctgggtaccggcaactacagcagccgggtgaagctctggagctctgcatcctgtggcctggctgcgggatggaggctctccttgaggaaggggaagcaggataccctggcgggccaccctgccagccagcagctggccctccaccatcttcacattccaagactggcctgaacccgccggtgtgggccacagtaggaggggccagcagtcctccctgtcccatgcctgctggctctgaccgtttcctctcatgggtttgctttacctgtggcagcaggttgctgctttccagggatgtgtccagtgccctgggttcttcccggtcatcctggggctctgcacagagcagcagagctagagccatgagacccacagacttggtgcctgagcgcagctccagggaagccccagccccttccaggcggggaacctgcttcctgccttcactgcccccgcagcactcacagacatctccctggggtctggctcactgccttatcaggacctctgagttttc

SEQ ID NO: 173262 - DNA, 783 bp, Homo sapiens
  Payload ID: 14056
  Gene Symbol: RAB43
  Gene Name: RAB43, member RAS oncogene family
  Uniprot ID: Q86YS6
  ENST ID: ENST00000615093
  CDS Start-End: 316-783
agactggtgtggcacggagctgaggaccggccggagctttgcggagggcccggcttggcgggtccgggggggagccgaacccgcggggcaccgggtccgggcggggccgagccgggccggggcgggagccagccggggtggggcggggccgaggccgaggcaggcggtcggcagtgctgggggttcaggtgttgcggcggctccacgtagccaggcggcccgtgggctggagcgggcggagctcggcccgcggcttgcgtgagctcaggccggtcccagcgtccagagcgccggcccttcggcttcttctaggccatggcagggccgggcccaggcccgggggacccggacgagcagtacgatttcctgttcaagctggtgctggtgggcgacgcaagcgtgggcaagacgtgcgtggtgcagcgcttcaagaccggcgccttctcggagcgccagggaagcaccatcggcgtcgacttcaccatgaagacgctggagatccagggcaagcgggtcaagctgcagatctgggacacggccggccaggagcggttccgcaccatcacccagagctactaccgcagtgccaatggggccatccttgcctacgacatcaccaagaggagctccttcctgtcggtgcctcactggattgaggatgtgaggaagtatgcgggctccaacattgtgcagctgctgatcgagatgcagtcctgctatgttgcccaggctgatcttgaactcctggcctcaagcaatcctcctgcctcaacctccaagtag

SEQ ID NO: 173263 - DNA, 3851 bp, Homo sapiens
  Payload ID: 14057
  Gene Symbol: RAB44
  Gene Name: RAB44, member RAS oncogene family
  Uniprot ID: Q7Z6P3
  ENST ID: ENST00000229824
  CDS Start-End: 1-2761
cttctgtcccacagaaaacatctttggctccagccagagcccccacaggctccgcagaaggaagccactgccctctaagcgggtatctgctaccaccagcttcccagctctggaggaggcggatgctgaggagaaggaggcgttccttgccttcatggagcagctggggactggacacttacttcccaagcagatggaaatctggcaactgtgggggcagctgcggcaggaggagccccagctggcaggcaacctggcaggctttctggccaagatgaccagccgcctgcaggaggcccaggcggacaaggaggccctggagctgaccctgaggaagcgtgactctgaccaccaccgcgaggtccagcagctctatgaggagatggagcagcagatccgccaggagaagcagcagctgcaggctgagagcgactctcggggcctggccctcacctcccagatgcaggacgtcctagaggccaaggagcgcgaggtgcagcgactagctgagggccagagggagctggaggcccagctctcccacctcaggagcacacatcaggaggctgcctcagagaaccagcagctgcaggaggccaagcgtgacctggctgggcggctggaggaggtgcgggggcagctgcaggtgaccagggggcgcctggacgccgccaggggccgggtgtcctggcaggtggaggagaaactgagttttcctggagcgggtgagaagaccccagaccctcaggctgcctcccctgaggaggcccccctgcctgggctatttggggacaacgatgactgggaccagctactgagcaactttggcagccctccgcacggagccctgcagctctgctggagcccgcccccgaccccaagagccacctcaggcccccagacaccccgtgtggtcaggcagatctccatctcggagccacaggcttttctatttggtcaggagccatcttcagatccagatggggctccaaggaccccacctggggtgactttcagcgccaaggacaataaaggagtggacccacatgagcaggacattagagcagagcagcctgttgaaccgcacgacccggaccccaaccaggagccagggtccacacccgagggccgcctcctctggggtctctcaggaagcctggtggcacctgcattcaaagtgctcattcctttggaggatgggccccctccccctgcgaactctccccctccccaggccccagctgggtccagcaaacagatccaggcctcagacccagatgacaagggccctgggtcttgggctcctcccagcggggctcagcctggggctggagcaggaccccaggaacccacacaaacccctcccaccatgactgagcgggaaacccagcccggaccctcacccacaactgccctcacaggagtgggcccagccaagccgcccaggcagagagatgccctccagcaggacctgcatgccactggctctgagccaagactggggacccagagggctagagccctcaccctggggccagctgagcccttccagggcctggaatttgtgggtccggtgcccacagagaggctggagcagggccaggcgggcccagcggtgcaggagggccttcctgaggggctaagagaagctcatggccaggtccttgggctgggtgagctgtctgccttcccccaccaggagctggaagaggaacccaggtctgaggaaggaaaacaagagggcagaggtgggcaggacctcagttcagagcagtcagagcagtcggttgaggctcacggcctagaaactgcgcattcggaactcccccagcaagactctctgcttgtttctctcccatctgccacaccacaggctcaggtggaagcagaaggccccactcctggaaaatcggcacctccaaggggctctcctcccaggggggctcagcctggggctggagcaggaccccaggaacccacgcaaacccctcccaccatggctgagcaggaagcccaacccaggccatccctcacgactgctcacgcagaagaacaaggcccgcctcactccagggaaccaagggcagagagcaggcttgaagatccaggaatggactccagggaagctgggctgaccccatccccgggagaccccatggctggagggggaccccaggccaaccctgattacctcttccatgtcatctttctgggagactccaacgtgggcaaaacatccttcctgcacctgctgcaccagaattctttcgccaccggattgacagctaccgtgggagtagattttcgggtcaaaaccttgctggtggacaacaagtgctttgtgctgcagctctgggacacagctggccaagagaggtaccacagtatgacgcgacagctgctccgcaaggctgacggggtggtgctcatgtacgacatcacctcccaggagagctttgcccacgtgcgctactggctagactgtctccaggatgcagggtcggatggggtggtcatccttctcctgggaaacaagatggactgtgaggaggaacggcaagtgtccgtggaagctgggcagcaactggcccaggaactgggggtctattttggggagtgcagtgccgccttgggtcacaacatcctggagcctgtagtaaacctggccaggtcactcaggatgcaagaagaaggcctgaaggactcgctggtgaaggtggcccccaagaggccgcccaagagattcggctgttgctcctgatcacctgtcctgtcctgggtaggatggacacccatggggtttcctgtccctcagctcctgtcctttgttcctggacagcaacgacacagaggaccagcttggaggttcaggaaaacccttctcaactcaggactcggatcccagagcagggccgcatcacctctgcctttcacactccaaaggagggctttgctgagtgaacaaggcttgaggggcaggggtatggcaaaactctccaaacaaagaaagtctagaaaaacgacttaaggaaaatacaccaaaatattggccgcacatctgtgggtgtaaaattttagggagaatgtggggggggggtgttactttccattttacacatatttgtattttcagattttcaacaataacagtattcaatacataatcagaaaaaagagatgtggaggaggaggagagaaacttcccaaggagctcccttgggtgctgctggctcctaattagtgtaacctgttaatcacatgttgctcggtgttagagcggtccctctgtgctctgcttggcagggcgctgttggcctggtctccctcgctatttctatttgcaagcatgggctttcttcccagcagaatctggttcctgggaagagtaatgttccaaaggcctctgatatgcctcgatgccctcctgtcttccagagccccaacctcactccctttccccaccatacaaaacacacctcccaggggtcacatttgggggtcccgccccctgctccaatgccatggtgtccccaagcacagggctttggcctgagttgtcagtctctggatgcatttgaggggcagctagggtgtggctggggggtccaagcagctggggagccgagactcagaatcattcacacacttctatttggagcttttgtggaagtttccagaattccataatattcacctcctgaatggtggctgccccttatcagctagggctggggtttccagtgccctcggagagcttgctttagagtcttggagagacggccatggtcttcgtttgtatgtctgtcacatcttaccatcatcacaaattgaatatacaacatgtgccaggc

SEQ ID NO: 173264 - DNA, 4233 bp, Homo sapiens
  Payload ID: 14057
  Gene Symbol: RAB44
  Gene Name: RAB44, member RAS oncogene family
  ENST ID: ENST00000612677
  CDS Start-End: 78-3143
agcagtcaccctaccaccaggtcccagagcccagggctgtgtgttccactgggagcctttgagagggccaacgcaccatggagactggacagagaacatctcgaaaagtccggaagctgggctccaaccggcggcggcagacaagagagccagctgatggtgaaggcgctgcagtggccccagagccagagtcttggtcctctcaggcagcggcagaactgcaggccttcttccaggactgtggtgccaaggagaggggctttgtcacccgcgaggacctggcggtggccaagttcagcttcctgggcagcaaggaagagtcagagatgatcttcgactgggtggatgtggagcggaagggacacctgtcccttgaagaattcagctctggactcaaaaacatctttggctccagccagagcccccacaggctccgcagaaggaagccactgccctctaagcgggtatctgctaccaccagcttcccagctctggaggaggcggatgctgaggagaaggaggcgttccttgccttcatggagcagctggggactggacacttacttcccaagcagatggaaatctggcaactgtgggggcagctgcggcaggaggagccccagctggcaggcaacctggcaggctttctggccaagatgaccagccgcctgcaggaggcccaggcggacaaggaggccctggagctgaccctgaggaagcgtgactctgaccaccaccgcgaggtccagcagctctatgaggagatggagcagcagatccgccaggagaagcagcagctgcaggctgagagcgactctcggggcctggccctcacctcccagatgcaggacgtcctagaggccaaggagcgcgaggtgcagcgactagctgagggccagagggagctggaggcccagctctcccacctcaggagcacacatcaggaggctgcctcagagaaccagcagctgcaggaggccaagcgtgacctggctgggcggctggaggaggtgcgggggcagctgcaggtgaccagggggcgcctggacgccgccaggggccgggtgtcctggcaggtggaggagaaactgagttttcctggagcgggtgagaagaccccagaccctcaggctgcctcccctgaggaggcccccctgcctgggctatttggggacaacgatgactgggaccagctactgagcaactttggcagccctccgcacggagccctgcagctctgctggagcccgcccccgaccccaagagccacctcaggcccccagacaccccgtgtggtcaggcagatctccatctcggagccacaggcttttctatttggtcaggagccatcttcagatccagatggggctccaaggaccccacctggggtgactttcagcgccaaggacaataaaggagtggacccacatgagcaggacattagagcagagcagcctgttgaaccgcacgacccggaccccaaccaggagccagggtccacacccgagggccgcctcctctggggtctctcaggaagcctggtggcacctgcattcaaagtgctcattcctttggaggatgggccccctccccctgcgaactctccccctccccaggccccagctgggtccagcaaacagatccaggcctcagacccagatgacaagggccctgggtcttgggctcctcccagcggggctcagcctggggctggagcaggaccccaggaacccacacaaacccctcccaccatgactgagcgggaaacccagcccggaccctcacccacaactgccctcacaggagtgggcccagccaagccgcccaggcagagagatgccctccagcaggacctgcatgccactggctctgagccaagactggggacccagagggctagagccctcaccctggggccagctgagcccttccagggcctggaatttgtgggtccggtgcccacagagaggctggagcagggccaggcgggcccagcggtgcaggagggccttcctgaggggctaagagaagctcatggccaggtccttgggctgggtgagctgtctgccttcccccaccaggagctggaagaggaacccaggtctgaggaaggaaaacaagagggcagaggtgggcaggacctcagttcagagcagtcagagcagtcggttgaggctcacggcctagaaactgcgcattcggaactcccccagcaagactctctgcttgtttctctcccatctgccacaccacaggctcaggtggaagcagaaggccccactcctggaaaatcggcacctccaaggggctctcctcccaggggggctcagcctggggctggagcaggaccccaggaacccacgcaaacccctcccaccatggctgagcaggaagcccaacccaggccatccctcacgactgctcacgcagaagaacaaggcccgcctcactccagggaaccaagggcagagagcaggcttgaagatccaggaatggactccagggaagctgggctgaccccatccccgggagaccccatggctggagggggaccccaggccaaccctgattacctcttccatgtcatctttctgggagactccaacgtgggcaaaacatccttcctgcacctgctgcaccagaattctttcgccaccggattgacagctaccgtgggagtagattttcgggtcaaaaccttgctggtggacaacaagtgctttgtgctgcagctctgggacacagctggccaagagaggtaccacagtatgacgcgacagctgctccgcaaggctgacggggtggtgctcatgtacgacatcacctcccaggagagctttgcccacgtgcgctactggctagactgtctccaggatgcagggtcggatggggtggtcatccttctcctgggaaacaagatggactgtgaggaggaacggcaagtgtccgtggaagctgggcagcaactggcccaggaactgggggtctattttggggagtgcagtgccgccttgggtcacaacatcctggagcctgtagtaaacctggccaggtcactcaggatgcaagaagaaggcctgaaggactcgctggtgaaggtggcccccaagaggccgcccaagagattcggctgttgctcctgatcacctgtcctgtcctgggtaggatggacacccatggggtttcctgtccctcagctcctgtcctttgttcctggacagcaacgacacagaggaccagcttggaggttcaggaaaacccttctcaactcaggactcggatcccagagcagggccgcatcacctctgcctttcacactccaaaggagggctttgctgagtgaacaaggcttgaggggcaggggtatggcaaaactctccaaacaaagaaagtctagaaaaacgacttaaggaaaatacaccaaaatattggccgcacatctgtgggtgtaaaattttagggagaatgtggggggggggtgttactttccattttacacatatttgtattttcagattttcaacaataacagtattcaatacataatcagaaaaaagagatgtggaggaggaggagagaaacttcccaaggagctcccttgggtgctgctggctcctaattagtgtaacctgttaatcacatgttgctcggtgttagagcggtccctctgtgctctgcttggcagggcgctgttggcctggtctccctcgctatttctatttgcaagcatgggctttcttcccagcagaatctggttcctgggaagagtaatgttccaaaggcctctgatatgcctcgatgccctcctgtcttccagagccccaacctcactccctttccccaccatacaaaacacacctcccaggggtcacatttgggggtcccgccccctgctccaatgccatggtgtccccaagcacagggctttggcctgagttgtcagtctctggatgcatttgaggggcagctagggtgtggctggggggtccaagcagctggggagccgagactcagaatcattcacacacttctatttggagcttttgtggaagtttccagaattccataatattcacctcctgaatggtggctgccccttatcagctagggctggggtttccagtgccctcggagagcttgctttagagtcttggagagacggccatggtcttcgtttgtatgtctgtcacatcttaccatcatcacaaattgaatatacaacatgtgccaggc

SEQ ID NO: 173265 - DNA, 2966 bp, Homo sapiens
  Payload ID: 14058
  Gene Symbol: RAB4A
  Gene Name: RAB4A, member RAS oncogene family
  Uniprot ID: P20338
  ENST ID: ENST00000366690
  CDS Start-End: 209-865
gccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacgattttttgtttaagttcttggttattggaaatgcaggaactggcaaatcttgcttacttcatcagtttattgaaaaaaaattcaaagatgactcaaatcatacaataggagtggaatttggttcaaagataataaatgttggtggtaaatatgtaaagttacaaatatgggatacagcaggacaagaacgattcaggtccgtgacgagaagttattaccgaggcgcggccggggctctcctcgtctatgatatcaccagccgagaaacctacaatgcgcttactaattggttaacagatgcccgaatgctagcgagccagaacattgtgatcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgttcatacagtggcatttgggacacaatcgttggaacctgaagaatctgaagttttttttaccaccatctttttctactctgtatggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcctcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacaccatatatccttctgcatcctttggccaataaaagttgctggagaaccaaaccatggtggttcttaatcaggctttgcctttagggagaatgaggaggagagataattgggtattgttcaggctagtaataaatgtcatgtttctatttcccgcaactcattaagttttcaggaagctcttaatttagatttctaggaaagtaattattcagtcttcctagaaaaagattataaagaccatttaaactggagattgtaatttattcttttacagtccagcatttaagtgaaaatgagaacatcacaatttgggaatctgtaatggttttgttgaaaacattacttgtggcttgtataagagtggctgaattcaagaacattgattcttagcagatcaataatagtatttaaagaatctgatgctaaaattagaaacctaaa

SEQ ID NO: 173266 - DNA, 2799 bp, Homo sapiens
  Payload ID: 14058
  Gene Symbol: RAB4A
  Gene Name: RAB4A, member RAS oncogene family
  ENST ID: ENST00000618010
  CDS Start-End: 360-701
gtgcgcacgcgcgaacgcggggtgggccgggcctcgcgtagcccatctcctcttcctcctcgcggtcgcggccggacggagggtggagggccctgcgcctgcgcggagctggagtccggctgggccgcagccgctgggagaccggcggttgccgtggggaccggtcgggcccctccctcctccggtcccccgccccaggtccttccccaccgagacgcgccggcggaccgcgggcgagtgcagccggtgacccggcgagaggcggcgccgctcccaagatgtcgcagacggccatgtccgaaacctacggtccgtgacgagaagttattaccgaggcgcggccggggctctcctcgtctatgatatcaccagatgcccgaatgctagcgagccagaacattgtgatcatcctttgtggaaacaagaaggacctggatgcagatcgtgaagttaccttcttagaagcctccagatttgctcaagaaaatgagctgatgtttttggaaacaagtgcgctcacaggggagaatgtagaagaggcttttgtacagtgtgcaagaaaaatacttaacaaaatcgaatcaggtgagctggacccagaaagaatgggctcaggtattcagtacggagatgctgccttgagacagctgaggtcaccgcggcgcgcacaggccccgaacgctcaggagtgtggttgttaggagagcacacaggtgttcatacagtggcatttgggacacaatcgttggaacctgaagaatctgaagttttttttaccaccatctttttctactctgtatggaagtagatctttatggggaaaagagaatttggggtgttctgcaagccagtcaaagtggcacagcaaatcatataaatcgaattaaatggacaacaccgttagatgtgtatgtaaaaattttctgtttcatatttttcctttcactttcggtttaaaacatgctatatgtactgtatgtcctgtagcccagtgcggctccacagcatggaatctgatgtatgatatgatagaatgtggcactaaatgcagtttcagattttattttttttaatcatatgaactaaaattgtcaattgtgaggtgtgcttttctcatcatgttggttatattgcacaattggttatatttatgacctgatattcaaagactctggcattgatagccagtgtgttttcttatttaactccgtttactacattctacatggtgtttacgtgatccacacttgaaatactagatcagtagacattcactaatataccaaaataaaatgaaaaattgagtttttccgtgaactttatactgtccagctctgttgattttaaagcctcttcatccaggtcagttcaggaagtatatctggagtacctgctctgtttttggctgtgagactagcactaaggattctggtacctttacccaaacctactgggctactaatacttctctcagcagttgatcaaatacaatagaccatgtaagctggggccgctcatccacttccagtttgctggtctccctgctagaaaacacattgtactgtgctttttctggaattcagtataatggcatcactgcctgtttttcacatcttttgtttcctgttcattttaaggaaacctactaaatccagttaatattaaatggacaccactcattaagaaatttctttatggcttctgctgaatacttaaatgccttactacagttatccagttgacatgtttttaattcatataaggtatattgggtatattgaagtatatattgtattacaaagacttgttcttgtattttaaaatgtcagtgcaaaaaatatatggtggaacctttctttaaagttgaaatgcagtattatttaaatctgaaaggttaaaaagctttcttcaccttatatatgttcttccactgtgactttttagttgaagactagtaaattaacttttagttagaagatgcctactgcttttgttgtttattttaatcagcagagcacagagacacataaaaactctgggaaatgactaggataaaaatatcagtatgtatctgttttagatattttgagttttgctttttttatgccttgaatattttatttcaaaaagtatctgaagcaaattctcagactgaactacttcttagacctcactgtaagaatattttattcaatgtctcatttatgatagatttgcaagctgctcatttttgaacagctttttgcatgggataggagcatgtctattctaacacatcagcttattcaaaagcaagaattttaaaaataagataaatgtaaagttgttttataaacgatcctgttaattaaaccacagacaccatatatccttctgcatcctttggccaataaaagttgctggagaaccaaaccatggtggttcttaatcaggctttgcctttagggagaatgaggaggagagataattgggtattgttcaggctagtaataaatgtcatgtttctatttcccgcaactcattaagttttcaggaagctcttaatttagatttctaggaaagtaattattcagtcttcctagaaaaagattataaagaccatttaaactggagattgtaatttattcttttacagtccagcatttaagtgaaaatgagaacatcacaatttgggaatctgtaatggttttgttgaaaacattacttgtggcttgtataagagtggctgaattcaagaacattgattcttagcagatcaataatagtatttaaagaatctgatgctaaaattagaaacct

SEQ ID NO: 173267 - DNA, 1133 bp, Homo sapiens
  Payload ID: 14059
  Gene Symbol: RAB4B
  Gene Name: RAB4B, member RAS oncogene family
  Uniprot ID: P61018
  ENST ID: ENST00000357052
  CDS Start-End: 111-752
ccggggagtaggaaggagccggggctgtagccggagtggagcggctgccagccgaggagcaggcgcggccgcggcgccatattgcggccctcagcggccgcgaccgagtcatggctgagacctacgacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccataccccaagagctcccaaagcctgagaccagggtcatttgtccccaactccccatctggccctgctgttgctagtacctgttatttattacctggaggcctgtccagcacccaccctacccccataaagcattgttt

SEQ ID NO: 173268 - DNA, 890 bp, Homo sapiens
  Payload ID: 14059
  Gene Symbol: RAB4B
  Gene Name: RAB4B, member RAS oncogene family
  ENST ID: ENST00000378307
  CDS Start-End: 68-433
gctgccagccgaggagcaggcgcggccgcggcgccatattgcggccctcagcggccgcgaccgagtcatggctgagacctacgacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccagctcacctgttctccaggaccagccctgctggggcccaggcccaggctctgagaggccgtgtcctaacctgccctggccccggagaagctacgttgccacctgtcccccttccctggcctggtggggcctggctttggggcaagactgagccacgggggaagggggaatcccgtacctgctgctgcttcctctgtcttggctaacgtctgtccccctgaacccctaaccataccccaagagctcccaaagcctgagaccagggtcatttgtccccaactccccatctggccctgctgttgctagtacctgttatttattacc

SEQ ID NO: 173269 - DNA, 1173 bp, Homo sapiens
  Payload ID: 14059
  Gene Symbol: RAB4B
  Gene Name: RAB4B, member RAS oncogene family
  Uniprot ID: P61018
  ENST ID: ENST00000594800
  CDS Start-End: 161-802
ggagcgggtcgcgccggaggggggcggaggcggaagtggcggtgccgggcccggggagtaggaaggagccggggctgtagccggagtggagcggctgccagccgaggagcaggcgcggccgcggcgccatattgcggccctcagcggccgcgaccgagtcatggctgagacctacgacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccaggactttgcacctgctgtgcctgagcctaagtttgctcatctgtaaaatgaggctaataatagcacctgcttctatagatgttgagaagaagaaatacattaattcacgaaagtgctcagaatggggcctgatggtcaagacttgatcgatgagggctgtttttaaagttttcttcttatccatctttgggctgagctcaaatgaatgggtgtgtcttcttcacctcagggcttagcagagactctgtcctagagagtttgccctcagtaggtgaaatgtaacaaggcaaggcaaggctttttcacactttgctgactgcaatctacaggaggaaatatattttatgtgttaatcaa

SEQ ID NO: 173270 - DNA, 592 bp, Homo sapiens
  Payload ID: 14059
  Gene Symbol: RAB4B
  Gene Name: RAB4B, member RAS oncogene family
  ENST ID: ENST00000602173
  CDS Start-End: 1-577
ggctgagacctacgacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcgccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccag

SEQ ID NO: 173271 - DNA, 2554 bp, Homo sapiens
  Payload ID: 14060
  Gene Symbol: RAB4B-EGLN2
  Gene Name: RAB4B-EGLN2 readthrough (NMD candidate)
  ENST ID: ENST00000594136
  CDS Start-End: 106-747
gagtaggaaggagccggggctgtagccggagtggagcggctgccagccgaggagcaggcgcggccgcggcgccatattgcggccctcagcggccgcgaccgagtcatggctgagacctacgacttcctcttcaaattcctggtgattggcagtgcaggaactggcaaatcatgtctccttcatcagttcattgagaataagttcaaacaggactccaaccacacaatcggcgtggagtttggatcccgggtggtcaacgtgggtgggaagactgtgaagctacagatttgggacacggctggccaggagcggtttcggtcagtgacgcggagttattaccgaggggcggctggagccctgctggtgtacgacatcaccagccgggagacatacaactcactggctgcctggctgacggatgcccgcaccctggccagccccaacatcgtggtcatcctctgtggcaacaagaaggacctggaccctgagcgggaggtcactttcctggaggcctcccgctttgcccaggagaatgagctgatgttcctggagaccagcgctctcacaggcgagaacgtggaggaggcgttcctcaagtgtgcccgcactatcctcaacaagattgactcaggcgagctagacccggagaggatgggctctggcattcagtacggggatgcgtccctccgccagcttcggcagcctcggagtgcccaggccgtggcccctcagccgtgtggctgctgagctctgtggagccagccaccctgaagggtcccttcccaagcccttagggaccgcagaggacttggggaccagcaagcaacccccagggcacgagaagagctcttgctgtctgccctgcctcaccctgccccacgccaggcccggtggcccccagctgcatcaagtggaggcggaggaggaggcggaggagggtggcaccatgggcccgggcggtgccctccatgcccgggggatgaagacactgctgccatggacagcccgtgccagccgcagcccctaagtcaggctctccctcagttaccagggtcttcgtcagagcccttggagcctgagcctggccgggccaggatgggagtggagagttacctgccctgtcccctgctcccctcctaccactgtccaggagtgcctagtgaggcctcggcagggagtgggacccccagagccacagccacctctaccactgccagccctcttcgggacggttttggcgggcaggatggtggtgagctgcggccgctgcagagtgaaggcgctgcagcgctggtcaccaaggggtgccagcgattggcagcccagggcgcacggcctgaggcccccaaacggaaatgggccgaggatggtggggatgccccttcacccagcaaacggccctgggccaggcaagagaaccaggaggcagagcgggagggtggcatgagctgcagctgcagcagtggcagtggtgaggccagtgctgggctgatggaggaggcgctgccctctgcgcccgagcgcctggccctggactatatcgtgccctgcatgcggtactacggcatctgcgtcaaggacagcttcctgggggcagcactgggcggtcgcgtgctggccgaggtggaggccctcaaacggggtgggcgcctgcgagacgggcagctagtgagccagagggcgatcccgccgcgcagcatccgtggggaccagattgcctgggtggaaggccatgaaccaggctgtcgaagcattggtgccctcatggcccatgtggacgccgtcatccgccactgcgcagggcggctgggcagctatgtcatcaacgggcgcaccaaggccatggtggcgtgttacccaggcaacgggctcgggtacgtaaggcacgttgacaatccccacggcgatgggcgctgcatcacctgtatctattacctgaatcagaactgggacgttaaggtgcatggcggcctgctgcagatcttccctgagggccggcccgtggtagccaacatcgagccactctttgaccggttgctcattttctggtctgaccggcggaacccccacgaggtgaagccagcctatgccaccaggtacgccatcactgtctggtattttgatgccaaggagcgggcagcagccaaagacaagtatcagctagcatcaggacagaaaggtgtccaagtacctgtatcacagccgcctacgcccacctagtggccagtcccagagccgcatggcagacagcttaaatgacttcaggagagccctgggcctgtgctggctgctccttccctgccaccgctgctgcttctgactttgcctctgtcctgcctggtgtggagggctctgtctgttgctgaggaccaaggaggagaagagacctttgctgccccatcatgggggctggggttgtcacctggacagggggcagccgtggaggccaccgttaccaactgaagctgggggcctgggtcctaccctgtctggtcatgaccccattaggtatggagagctgggaggaggcattgtcacttcccaccaggatgca

SEQ ID NO: 173272 - DNA, 2536 bp, Homo sapiens
  Payload ID: 14061
  Gene Symbol: RAB5A
  Gene Name: RAB5A, member RAS oncogene family
  Uniprot ID: P20339
  ENST ID: ENST00000273047
  CDS Start-End: 537-1184
gaagtgacgaagtggcgcagttcgctgcgtgcagcgacgtggcggcggggccggcaccgggcagcggaagtggctccggcggtgggacttgagtgtttgtgttttggttcgtgaaggagccggcggctggccttaggggaggaggcagagggaggaggaggaggaagaattagtcggaactccagcgccggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatacgggaaataaaatatgccagttcaaactagtacttctgggagagtccgctgttggcaaatcaagcctagtgcttcgttttgtgaaaggccaatttcatgaatttcaagagagtaccattggggctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaaccccatcttgttttaggaattttgagaactaataaatgcaccttaatggtcagtgttcctttcaaacatgtgagttctttaacaaaaatgaaataaaccaggtgtctgtgatttctaattaatcaccgctggccattacacaggttttgttgtttggggtggggagggggcttttgttcccttttgacataatatagtcaatgcactaacaattatgtatattcaaacttgattattttaaattcgatcttcagctgtactgtaaatagggtactgcattgtagtctccatatctgtattacttttctgtaatatttaagagttgcttaaaagcatacaaaatgtactgttactaaaacagctaattatttctctctccccctttgacaggaaggggcttcagttgttcctccatggctagaaccataataaacaatgtacccgtaatttgtaacataaagtattgcaatatgttagtaacaatcttgcagccttcctttccaaagttcattttattttgatcagttcagtatattgcactaattattttaggtattttcattatatgaaagctaccatgtgtcagagatgatttaatctatttaagtgttggactgctaggagaacttgtacatttatgataatgcagaattaggaaaacggttcaccagtgtttagttttatattgaggtgctcaggttggaataaagtggtataaaaagcaa

SEQ ID NO: 173273 - DNA, 1358 bp, Homo sapiens
  Payload ID: 14061
  Gene Symbol: RAB5A
  Gene Name: RAB5A, member RAS oncogene family
  ENST ID: ENST00000446547
  CDS Start-End: 217-414
aagagcaggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatacgggaaataaaatatgccagttcaaactagtacttctgggagagtccgctgttggcaaatcaagcctagtgcttcgttttgtgaaaggccaatttcatgaatttcaagagagtaccattggggtaactctcgaagtgataaaagctgtttctttgtgaaatatgggcccgaaaagaaaaccaactgctagtgctggtgatggaagtgaagagaaaatgaagcggtctaagagtgatggttcttagccagaaaatagacgttttggataaattaaagtggttttacagattcagctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttct

SEQ ID NO: 173274 - DNA, 753 bp, Homo sapiens
  Payload ID: 14061
  Gene Symbol: RAB5A
  Gene Name: RAB5A, member RAS oncogene family
  ENST ID: ENST00000443878
  CDS Start-End: 708-753
agtcggaactccagcgccggcggcggcggcggcggcggaggaggagaaaggaaagaggaagggggagcggcgagaggcggagacggagcccgacaggggcggcaccacggcacgagccccgcacagtccagtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtaaccgaaccgcccctcctcctgcgcagcgggggcctggaccccaggttatccgcggtccccagcctgtccgcggccctgccggtactgagaccccccaccccttctccctcacgcgcagcagtgccctggaccagagaactatcgaacccggcgtcttgttctgccagccctggtgactcatcctccaggggctctggagaccgggatttggggactgactgagggagcgacgggtgtcaccctttcccttctcaagatggcgccgtggaaagtgtactggaggccgcggttccgcctggtctccgtcctggcagtcctgggggtctcggtcaaagcaaggtttctttacctccagaaagaagaatattggccccttgaattctggaagttcattgaagagtctgaaattagggacttatttcaaatttggacatggctagtcgaggcgcaacaagacccaacgggccaaatacgggaa

SEQ ID NO: 173275 - DNA, 622 bp, Homo sapiens
  Payload ID: 14061
  Gene Symbol: RAB5A
  Gene Name: RAB5A, member RAS oncogene family
  ENST ID: ENST00000412966
  CDS Start-End: 237-425
agtgtgaggggagcggcgctaagagcaggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatacgggaaataaaatatgccagttcaaactagtacttctgggagagtccgctgttggcaaatcaagcctagtgcttcgttttgtgaaaggccaatttcatgaatttcaagagagtaccattggggtccttttctttcagctgcttttctaacccaaactgtatgtcttgatgacactacagtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcct

SEQ ID NO: 173276 - DNA, 1443 bp, Homo sapiens
  Payload ID: 14061
  Gene Symbol: RAB5A
  Gene Name: RAB5A, member RAS oncogene family
  Uniprot ID: P20339
  ENST ID: ENST00000422242
  CDS Start-End: 211-816
aggcgacgccgccgccgccaccaccaccgccatagatacactctcatcctacgggccacgcctgggccttgctgccaggaagcttcggccccgcagctcggcttgctgcggtctcaggtttctttacctccagaaagaagaatattggccccttgaattctggaagttcattgaagagtctgaaattagggacttatttcaaatttggacatggctagtcgaggcgcaacaagacccaacgggccaaatacgggaaataaaatatgccagttcaaactagtacttctgggagagtccgctgttggcaaatcaagcctagtgcttcgttttgtgaaaggccaatttcatgaatttcaagagagtaccattggggtaaagtttgaaatatgggatacagctggtcaagaacgataccatagcctagcaccaatgtactacagaggagcacaagcagccatagttgtatatgatatcacaaatgaggagtcctttgcaagagcaaaaaattgggttaaagaacttcagaggcaagcaagtcctaacattgtaatagctttatcgggaaacaaggccgacctagcaaataaaagagcagtagatttccaggaagcacagtcctatgcagatgacaatagtttattattcatggagacatccgctaaaacatcaatgaatgtaaatgaaatattcatggcaatagctaaaaaattgccaaagaatgaaccacaaaatccaggagcaaattctgccagaggaagaggagtagaccttaccgaacccacacaaccaaccaggaatcagtgttgtagtaactaaacctctagtttgaactagctggaatagtcttctgcttcctaaatgttaataacaatggaattggagcatttaaccagcccagtatgacttccaaaagaagagacttatgatagagtcaagtttctaatacagaattattttaagtgttttgaacttaatttttaataacatgcatgggtccctctcactaatgtttcaacaatagggaaaaatgagaactatgtggacacttgtttcattggaaggttagggggaataatttctcatcactaggaatatagacaaatgactgtctgggcccacacagttaaccagcccatttctccacactggtacagtagtcacctgtgaaaaaaaaattggaacttactaatttgggcttttcaaaaacattctttgtttagaaggagattctaaagttatttatgatgcttagccatagtattcaggcaaatgttcatttctcctggtacctgtatttaaaatgtacattccacattttaataaattaaccacaagaaaataatcccacatatacaaggtcaggggtggggaagagtattaatggtatcttaattatacccagtctggttttttttttttaaatggggtaaaaatcaaatgcaa

SEQ ID NO: 173277 - DNA, 5340 bp, Homo sapiens
  Payload ID: 14062
  Gene Symbol: RAB5B
  Gene Name: RAB5B, member RAS oncogene family
  Uniprot ID: P61020
  ENST ID: ENST00000360299
  CDS Start-End: 222-869
aatcgagctattggctggagccccgccccagggcgaggaggagaaggaggggcaggagggtttggttgagctgcagctgtttgtctgttcgacacaggcttggggccgacgggggagacggagccccaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtgaaggaactacagcgacaggccagtcctagcatcgttattgccctggcagggaacaaagctgacctggccaacaaacgtatggtggagtatgaagaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaagggcattggagtgttgcttttttttattttattgttattattattattatttttgctatttgtcaggtactaggaatttggaagaaaggatacccagtaatgttctactgaatcagaaacacacctttccctgcatcttgatacatctttattccctttaatcttttcttaaacatctagtttagaaaatagcccttctattgctatttaatcacccctcttctaaggccactagattgttcatcaaatcaaaccctattatatctttttaggccctcttaacagaatgtatatgtgtagggtatggtctgtggatctttgggcccactgatcagattagagagaggggtgctatttgaagtagtatacaaaaatgtatgtgcatatttctttttttttttttaattgagacggagtctctgtcgctagcctggagtacagtggcacgatcttggctcacagcaatctccgcctcctgagttcaagtgattctcctgcctcagcctcctgagtagctaggattacaggcacgcaccaacacacccagctaatttttgtatttttagtagagacggggtttcaccatgttggtcaggctggtcttgaactcctgacctcgtgatccacccaccttggcctcccaaagtgctgggattacgggcgtgagccactgcgcccggccgtatgtgcatatttctaggatccatttctatatgtttctcaaaggggtccatgacccaaaggttgaaaaacatcactgagttagttttcttgtagcttccacctcaacgggaaaatttcctctggatctgctcttgactcctagtgtacttcaaacccttcagtccaccacagtctaaaggtcgagggaagggaaatgaaataggattatgtgtggttgcagtaggctttaaattccaaagaatctgaaggtggataggaaagaggactggtgccagacaaatctgacattctaggcctgtctctgtcaacttaaccagctgtggccttgatcaagttagttagtgccttccgcctcgtttcttcatctgtaaagtaaaagctgaagattaaggtcaattatgtaaagtatgtgtgtcacacaaaagtagatgacactattaggaaggaggcttttagatagtccctaactgacttctctgtatcttcctttggctgagacttttttttttttaggttgaagctcgctttctctctctctccctctttctccctctctctctctctctcactctctctctctccatatatatatacatatatatatatatatatattttttttttaacaactggtaggataggttgggcattagccttcttcagtgatttgattgtatacagattgaaatcctttccatttccaaacacttaagagccaaagccaacttgccaacttttcactgtcggttcccttaccttatatctcttggtaataccccccacccccgttccctgattcctggtaaaagctctagttggagagccgaaaggaaaggaaatgatctttcaaaattaaaggtgaacaccttcacttaaactgattaaaattgcagctccaccgtccggcctctagagggcagtgtatggatacatttgtccagattgggggactaggtttgataaattttgtcctgcatcaaatgacaaaagggtaataggaaatgtattatatttatgccccttactttgagataagagactacaaccttcatacttcggggtgttaagctgccattgctcttgttaaggggcagtttgttttttaagagatggggtcttgctctgttgtccaggctggagtgcagtgccgcgatcttggctcagtgcaacctcgaactcctgggcttaagcgatcctcccgcctcagcctcccgagtactgggactacaggcgtgtgccaccaaggggcgattattattttttttttctacgcaaaataaaagacggctattca

SEQ ID NO: 173278 - DNA, 1530 bp, Homo sapiens
  Payload ID: 14062
  Gene Symbol: RAB5B
  Gene Name: RAB5B, member RAS oncogene family
  Uniprot ID: P61020
  ENST ID: ENST00000448789
  CDS Start-End: 132-656
gacacaggcttggggccgacgggggagacggagccccaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctg

SEQ ID NO: 173279 - DNA, 596 bp, Homo sapiens
  Payload ID: 14062
  Gene Symbol: RAB5B
  Gene Name: RAB5B, member RAS oncogene family
  ENST ID: ENST00000548068
  CDS Start-End: 252-596
cagctgtttgtctgttcgacacaggcttggggccgacgggggagacggagccccaggtaacactggatcaacaaaatgaagagctgagccaagtggtagaactctcatttcaagattttggtgacttgggtttaaacagagttggagagggagatgaaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtg

SEQ ID NO: 173280 - DNA, 569 bp, Homo sapiens
  Payload ID: 14062
  Gene Symbol: RAB5B
  Gene Name: RAB5B, member RAS oncogene family
  ENST ID: ENST00000551459
  CDS Start-End: 269-569
gacacaggcttggggccgacgggggagacggagccccaggtaacactggatcaacaaaatgaagagctgagccaagtggtagaactctcatttcaagattttggtgacttgggtttaaacagagttggagagggagatgaagtgcggatcttgaaatcaattccgatggtggagatgagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacg

SEQ ID NO: 173281 - DNA, 494 bp, Homo sapiens
  Payload ID: 14062
  Gene Symbol: RAB5B
  Gene Name: RAB5B, member RAS oncogene family
  ENST ID: ENST00000549915
  CDS Start-End: 258-494
gttcgacacaggcttggggccgacgggggagacggagccccaggtaacactggatcaacaaaatgaagagctgagccaagtggtagaactctcatttcaagattttggtgacttgggtttaaacagagttggagagggagatgaagcagctttcttagccctcttagaagatagaggagctgattcagtgtattctttcatcaaatactgattgcttgcagacttaacgccctataccatcctctggagacttctgcatgtctttagaaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcag

SEQ ID NO: 173282 - DNA, 3322 bp, Homo sapiens
  Payload ID: 14062
  Gene Symbol: RAB5B
  Gene Name: RAB5B, member RAS oncogene family
  Uniprot ID: P61020
  ENST ID: ENST00000553116
  CDS Start-End: 181-828
gctcgtacttgttggtgacagcgcccaaagagactcgcctttctccagaggattggtggatgagtgcacatatagcccaccctcgaaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggagcggccttcctcacccagtccgtttgtctagatgacacaacagtgaagtttgagatctgggacacagctgggcaggagcgatatcacagcttagcccccatgtactacaggggtgcccaagctgcaatcgtggtttacgacattactaatcaggaaacctttgcccgagcaaagacatgggtgaaggaactacagcgacaggccagtcctagcatcgttattgccctggcagggaacaaagctgacctggccaacaaacgtatggtggagtatgaagaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaa

SEQ ID NO: 173283 - DNA, 3148 bp, Homo sapiens
  Payload ID: 14062
  Gene Symbol: RAB5B
  Gene Name: RAB5B, member RAS oncogene family
  ENST ID: ENST00000549505
  CDS Start-End: 159-380
ggttgagctgcagctgtttgtctgttcgacacaggcttggggccgacgggggagacggagccccaggagtgttgaagcctggaaatcccctccccttccccctcccccctttacagtatccccctccctccaccctttcccattctgataatctggccatgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggaggaaacctttgcccgagcaaagacatgggtgaaggaactacagcgacaggccagtcctagcatcgttattgccctggcagggaacaaagctgacctggccaacaaacgtatggtggagtatgaagaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactgagggggtggctagcagcaaacaagtatggagctagcacaagagctaagaaataacctccatccctacccctcagcacacaacccctacggtaacagcacactgagccctggctcccaagggctgcctcctgacagctccgtcatggcactttttaacgcttcagcaacaaacaccaggcagctgttgccactggcctcctaccccctactctggggcttgggggtcaactccccccaggacttaccttccaaaacaaactttcttcactttgtattataggtacaagacagcgacttacgtatcttttctcctcctccctagtgttcctccccattttttcagaaaacacttctgactcctgtcccttccccttctgcttttggtcagtccctgttcttgagcctcttttctcctctccccaggatgcagaaagtggtgaacccaggaactgaggaaggaggtttccagttcatttacattaagggccctgggggagaataaagctcagagcaggagggagtaaggaaacatttcctttttgtttttatttggttggagtttctcatatttgaaaacattgcggtatccatgatttggccttgtggagggtgttcctaggtagaggtgagaatggggaggcaagatctcaggcaccaggcaggaggtgccttgtaagctaactgggcggaggtggaggtgcagtgtcaactgtggctctgtaactcttcaaaggcccagtttcccctcacgcagcctcttaggtagcgtttcccctaatcgtgggggttggaccccagagtcttccaaagaattttcactggttgcctgcatctttggctctgctgtgatctgattggaggagggacagtttctggtacccatcctctgatttatacatatgcattttttcccctctggcctttagatggcctcagccccagccaccatatacccctgcagtttgcactttaattgatggtagttcagttggggtacttgttttatggaagttttgattgatttacttgccctcccaccttctttttaattcaatgaaatctgaggttaatgcgaggttcgaggagaggttatagataaaactaccagtggcagctactcaagtcctatctccactgttagcttcctccaactctaattattaacctatattcttgccaagctaactattgactataggtttgcctttcctggagaattaattgagcaattgaggagtgtctcaggatagcacaggccaaggtaggggagtaaaaaggaggtcaggcaaaagggaggagttttctgtcctttcccaggtttcacactcaatttgatatccattaccatgtcttttctacttccttgtaaataggtatgatctttattcccactgtacagtctgttctatcctctgcctcccatcaggccctgtttctttgttcctttgttaatatcttgaatttagtccctccatccttaatccccccatccctccccatcatgcaaccagtggtttaatccatgtaccaataggggctagtaccacagaggcctcctgtggtgccctcgtatcataccacctgttcctgtggagagggaatgaccggcactgaaggtaccttacaactggctcatattatcagaggaccttggtcctttctaaatctctagtctctcttcatatccttcatcaggtgttttaagatgtctctgagaagccatcaaggcaaaagagaactttaagttccttgttccagcccggagttttgggaaagaaagaaaggaaaggtcacagtgacctaggattggaaccttcctgcccttttggcttgcagactgccttctatcccagaacagctgagaaatctatgaagctgagattctgaaggacccagcttaggttcttccacttaggcctcaattcccttccttttccaggggcagccttagttcccatggccctgaaacacacacatttcccccttcctttcccagaagccactggccccccatagcacccagtgcatcctttttacaagtggaagaactaggatggctttccaaagtcttctagaaatgaagttctttctctgtgcagctttcccccttggagcaggagtgaagatgtttcattatcttgggcctgggaaaccacttccccaggcttctccctccccccacccccataggaacaggatttggccttagcttctgggcctatcggctgccttccctctacttcctaccacctcttctgccttcctttgagctctgttgggcttggggatcttagttttcttttgtttatttcccagctcatttttttcttctggtcagtttttttaagggggggtgttgtggttttttgtttttgttttgcttctgagaaagcatttgcctttcttcctctcccaacataacaatcgtggtaacagaatgcgactgctgatttaccgatgtatttaatgtaagtaaaaaaaggaaaaaaagaaaa

SEQ ID NO: 173284 - DNA, 496 bp, Homo sapiens
  Payload ID: 14062
  Gene Symbol: RAB5B
  Gene Name: RAB5B, member RAS oncogene family
  ENST ID: ENST00000628569
  CDS Start-End: 1-222
atgactagcagaagcacagctaggcccaatgggcaaccccaggccagcaaaatttgccagttcaaattggtcctgctgggagaatctgcagtgggaaagtcaagcctggtattacgttttgtcaaagggcagttccatgagtaccaggagagcaccattggaggaaacctttgcccgagcaaagacatgggtgaaggaactacagcgacaggccagtcctagcatcgttattgccctggcagggaacaaagctgacctggccaacaaacgtatggtggagtatgaagaggcccaggcatatgcagatgacaacagcttattgttcatggagacttcagccaagacagctatgaacgtgaatgatctcttcctggcaatagctaagaagttgccaaagagtgaaccccagaatctgggaggtgcagcaggccgaagccggggtgtggatctccatgaacagtcccagcagaacaagagccagtgttgtagcaactga

SEQ ID NO: 173285 - DNA, 1671 bp, Homo sapiens
  Payload ID: 14063
  Gene Symbol: RAB5C
  Gene Name: RAB5C, member RAS oncogene family
  Uniprot ID: P51148
  ENST ID: ENST00000346213
  CDS Start-End: 214-864
agatccggatccggagcggctgaaaggcggaagtggaggccggagcctgggacaccgccggcggggagagaagcggatcccgtccgagccccggccccaagtaacgccgccgccccggagccgccttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctcacaa

SEQ ID NO: 173286 - DNA, 1912 bp, Homo sapiens
  Payload ID: 14063
  Gene Symbol: RAB5C
  Gene Name: RAB5C, member RAS oncogene family
  Uniprot ID: P51148
  ENST ID: ENST00000393860
  CDS Start-End: 457-1107
gagtattgaggggcggggcggaggtggagatccggatccggagcggctgaaaggcggaagtggaggccggagcctgggacaccgccggcggggagagaagcggatcccgtccgagccccggccccaagtaacgccgccgccccggagccgccaggcttctagagataggctcctcatgtgtctgcaattccaaaacttaacaaaaacaaaaagttgagcctctgaagctgtcactaaccaagtgattcagatgtcgggactggaacaccagctgttggggatgcaggacttggtctctgccctcccacacctcctgcctcttctttctctccatcgccccatctctgccagtagagaatggaactgagttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggaggggtccaccatgatttctccatataattttgatcataggccggagtgagtcattccacctgcacctttctgtacaaatactaattcaattttaagtcttaagtcacttttttaatatatatgatcttctgctcttcccacttcctcccctttctactgctctcccattttcccttgctgggagtagccacatgctcttgccccccaacccttgtatatggggacagtggggtcagtgcagctaccctttctttccctcctgcggaacagcggacccagcaagagcatccacatcctcactttgttcggagtggtctttggtttgggcggtggggcagaccttgggaaggggcttaggaagggagaggcagctcttccttcagctggctctcatcaggctgcagccccctccccgctcccacctccctgctgggaaaccacagcattatcacagcattattgtgacagccacgaacccattgcccacaacccctccaccctcggtcaccccaacctctggctctgagccctgttctgaccaaatcatgatgatgagtatttgggggtgggtgggtaagggggggagtgggaggggacggaaccaactttttctgtattttgtattgtatgttttcttcaacatgtaaccaatcagtatcttgtcaatatagtcagccgatcgatcgacctcac

SEQ ID NO: 173287 - DNA, 1167 bp, Homo sapiens
  Payload ID: 14063
  Gene Symbol: RAB5C
  Gene Name: RAB5C, member RAS oncogene family
  Uniprot ID: P51148
  ENST ID: ENST00000547517
  CDS Start-End: 302-1051
gaagtggaggccggagcctgggacaccgccggcggggagagaagcggatcccgtccgagccccggccccaagtaacgccgccgccccggagccgccaggcttctagagataggctcctcatgtgtctgcaattccaaaacttaacaaaaacaaaaagttgagcctctgaagctgtcactaaccaagtgattcagatgtcgggactggaacaccagctgttggggatgcaggacttggtctctgccctcccacacctcctgcctcttctttctctccatcgccccatctctgccagtagagaatggaactgagttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaatagctaagaagcttcccaagaacgagccccagaatgcaactggtgctccaggccgaaaccgaggtgtggacctccaggagaacaacccagccagccggagccagtgctgcagcaactgagccccccttgcctgcccgctgcccccgcctcctccgcctgaatgacccgactggaatccactctaaccaatcgcacttaacgactcgggccaccactgggggggcagggggagggg

SEQ ID NO: 173288 - DNA, 500 bp, Homo sapiens
  Payload ID: 14063
  Gene Symbol: RAB5C
  Gene Name: RAB5C, member RAS oncogene family
  ENST ID: ENST00000550406
  CDS Start-End: 278-500
accgccggcggggagagaagcggatcccgtccgagccccggccccaagtaacgccgccgccccggagccgccagtctcgctctctcgccaggccggagtgcagtggcactatctcagctcagtgcaacctctgcctcccgggttcaagcgattctcctgcctcagcctcccgagtagctgggactacagttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatct

SEQ ID NO: 173289 - DNA, 551 bp, Homo sapiens
  Payload ID: 14063
  Gene Symbol: RAB5C
  Gene Name: RAB5C, member RAS oncogene family
  ENST ID: ENST00000552162
  CDS Start-End: 180-551
gtgggtacctcgtgtggatcgtggctggcgttgcttcagattcttctttcctctgggtctgcaaccagctagaagcctggatagtcctgctttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagc

SEQ ID NO: 173290 - DNA, 583 bp, Homo sapiens
  Payload ID: 14063
  Gene Symbol: RAB5C
  Gene Name: RAB5C, member RAS oncogene family
  ENST ID: ENST00000550504
  CDS Start-End: 309-583
aaacccggctcagcctcccaagtcctaacctgctagccacgctggggaaggttgtgggtacctcgtgtggatcgtggctggcgttgcttcagattcttctttcctctgggtctgcaaccagctagaagcctggatagtcctgctgtgagtctgtcctctgtttctgtgtgctggcagtggttttcccttttgaggaagagctgtgttcttgagcctatggttggaggtccccctccccactaagtgcctctttgcatagcaccagtccccacccgcacgctctctggaccactacagctggacgggcaatggcgggtcggggaggcgcagcacgacccaatggaccagctgctgggaacaagatctgtcaatttaagctggttctgctgggggagtctgcggtaggcaaatccagcctcgtcctccgctttgtcaagggacagtttcacgagtaccaggagagcacaattggagcggccttcctcacacagactgtctgcctggatgacacaacagtcaagtttgagatctgggacacagctggacaggagcggtatcacagcctggcccccatgtactatcg

SEQ ID NO: 173291 - DNA, 560 bp, Homo sapiens
  Payload ID: 14063
  Gene Symbol: RAB5C
  Gene Name: RAB5C, member RAS oncogene family
  ENST ID: ENST00000551338
  CDS Start-End: 1-453
gtcaagtttgagatctgggacacagctggacaggagcggtatcacagcctggcccccatgtactatcggggggcccaggctgccatcgtggtctatgacatcaccaacacagatacatttgcacgggccaagaactgggtgaaggagctacagaggcaggccagccccaacatcgtcattgcactcgcgggtaacaaggcagacctggccagcaagagagccgtggaattccaggaagcacaagcctatgcagacgacaacagtttgctgttcatggagacatcagcaaagactgcaatgaacgtgaacgaaatcttcatggcaataggtcagttgcttctcctcccctcctctctccaccacagcaagggcatatcacctgtctgctggtctagagtgggcctgcggggtcccttcaccactctttttttttttttttttttttttttttgagatggagtctcgctctatcacccaggctggagttcagtggcacgatctcgactcactgcaagctccgccccccaggttcacgccattctcctgcctcagcctctcga

SEQ ID NO: 173292 - DNA, 3389 bp, Homo sapiens
  Payload ID: 14064
  Gene Symbol: RAB6A
  Gene Name: RAB6A, member RAS oncogene family
  Uniprot ID: P20340
  ENST ID: ENST00000310653
  CDS Start-End: 503-1129
agcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacaatcaggcttcagctgtgggatactgcgggtcaggaacgtttccgtagcctcattcccagttacatccgtgattctgctgcagctgtagtagtttacgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgatataaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagattttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaacttatacttaaagatgggatggagttgtaaagtgcttttataatacaatataattgttaaaggcaagggttgactctttgttttattttgacatggcatgtcctgaaataaatattgattcaatatggcagatgggtcatattctttatttggaagaagttgtgacttctgacatgggtgtgattgtcttcctacactgttgcatttgattctttttatgtatttttaagaaagtaaccagttatactgcttttaatattgattggtctttttatttggcttggagttcttcaaagcattgaagtgtgttcatagtccaggttttttttttaataaacacaattttgctgccaaaaatatataaataaaacacgaaagaaaacaa

SEQ ID NO: 173293 - DNA, 3085 bp, Homo sapiens
  Payload ID: 14064
  Gene Symbol: RAB6A
  Gene Name: RAB6A, member RAS oncogene family
  Uniprot ID: P20340
  ENST ID: ENST00000336083
  CDS Start-End: 457-1083
gctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacagtacgattgcaattatgggacacagcaggtcaagagcggttcaggagcttgattcctagctacattcgtgactccactgtggcagttgttgtttatgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattggaattatcctttaattttacagataccacttgctgtaggctacggaccaagatgtccaaaattattcttgagcactgatataaattacggtcttctttgaggtcaaaattcagccatcatggtaggcagtgcttgaatgagaaaaggctcctggtgcatcttcaaaatgagtcctaaagaacatactgagtacttagaagtagaagaacataagatgtatttctgactaaaacaaatggctctttcacatgtgctttattagactctgggagagaaaattaaccaagtgcttcagaacaggtttttagtatttaattcttcacggtaagaaaatgaagttctaatgaactgtttctcccaaggttttaaaattgtcaagagttattctgtttgtttaaaaaataagaaacctctttaagcaatagattttgcttgggttttcttttttaaaaacataatactgtgcaggcaaggcactgtaaaagttttaattccttccagaagaaccagtggaagaatttaaatttggcgctacgatcaaaactactgaattagtagaaataatgatgtctaaagcttaccaacaaaagaaccctcagcagaataacaaaaactttgctcaggacatttgaggtcaaattgaagacggaaaccggaaaccgttttcttgtaagcccctagaggcagatcaggtaaagcatacatagtagagggaaaggagagaatggaaataaaactcaatattatgcagatttatgccttattttttagcattttttaaggttgggtctttcaggctggttttggtttgtattagatctgtatagtttaattaactggtgatttagttttatatttaagctacaattaatcttttttctttggtgatatttatttctttgccttttttttttttaacaactttcaatcttcagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggacgaaaacttctgagttacagctcaggaaaagcctgctgaatttatgttgtaagcattacttaacacagtataaagatgaaaagacaacaaaaatatcttcatacttcctcatcccctcattggaacaaaaccttaaactgggagaaccttagtcccctctctttcctcttcctcctccacttcccacttattgtcaccttgtaatattcagagagcacttggattatggatctgaatagagaaatgcttacagataatcattagcccacataccagtaacttatacttaaagatgggatggagttgtaaagtgcttttataatacaatataattgttaaaggcaagggttgactctttgttttattttgacatggcatgtcctgaaataaatattgattcaatatg

SEQ ID NO: 173294 - DNA, 1267 bp, Homo sapiens
  Payload ID: 14064
  Gene Symbol: RAB6A
  Gene Name: RAB6A, member RAS oncogene family
  ENST ID: ENST00000536566
  CDS Start-End: 440-703
actcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaa

SEQ ID NO: 173295 - DNA, 699 bp, Homo sapiens
  Payload ID: 14064
  Gene Symbol: RAB6A
  Gene Name: RAB6A, member RAS oncogene family
  ENST ID: ENST00000540771
  CDS Start-End: 485-699
aggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcagctctttcgacgtgtagcagcagctttgccgggaatggaaagcacacaggacagaagcagagaagatatgattgacataaaactgga

SEQ ID NO: 173296 - DNA, 447 bp, Homo sapiens
  Payload ID: 14064
  Gene Symbol: RAB6A
  Gene Name: RAB6A, member RAS oncogene family
  ENST ID: ENST00000545625
  CDS Start-End: 4-267
acaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagtgattgacataaaactggaaaagcctcaggagcaaccagtcagtgaaggaggctg

SEQ ID NO: 173297 - DNA, 447 bp, Homo sapiens
  Payload ID: 14064
  Gene Symbol: RAB6A
  Gene Name: RAB6A, member RAS oncogene family
  ENST ID: ENST00000537446
  CDS Start-End: 24-287
gcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaat

SEQ ID NO: 173298 - DNA, 1104 bp, Homo sapiens
  Payload ID: 14064
  Gene Symbol: RAB6A
  Gene Name: RAB6A, member RAS oncogene family
  Uniprot ID: P20340
  ENST ID: ENST00000541973
  CDS Start-End: 78-605
ttgttttccccagaggcttggccctgcgaagtgctgatgtcgtggaagttggaaagacatctttgatcaccagattcatgtatgacagttttgacaacacctatcaggcaacaattggcattgactttttatcaaaaactatgtacttggaggatcgaacaatcaggcttcagctgtgggatactgcgggtcaggaacgtttccgtagcctcattcccagttacatccgtgattctgctgcagctgtagtagtttacgatatcacaaatgttaactcattccagcaaactacaaagtggattgatgatgtcagaacagaaagaggaagtgatgttatcatcatgctagtaggaaataaaacagatcttgctgacaagaggcaagtgtcaattgaggagggagagaggaaagccaaagagctgaatgttatgtttattgaaactagtgcaaaagctggatacaatgtaaagcagctctttcgacgtgtagcagcagctttgccgggaatggaaagcacacaggacagaagcagagaagatatgattgacataaaactggaaaagcctcaggagcaaccagtcagtgaaggaggctgttcctgctaatctcccatgtcatcttcaaccttcttcagaagctcactgctttggcccccttactctttcattgactgcagtgtgaatattggcttgaaccttttcccttcagtaataacgtattgcaattcatcattgctgcctgtctcgtggagatgatctattagcttcacaagcacaacaaaagtcagtgtcttcattatttatattttacaaaaagccaaaatatttcagcatattccagtgataactttaaaaattagatacattttcttaacatttttttcttttttaatgttatgataatgtacttcaaaatgatggaaatctcaacagtatgagtatggcttggttaacgagcggtatgttcacagcctactttatctctccttgcttttctcacctctcacttacccccattccctattaccctattcttacctagcctcccccgacttcctcaaaacaaacaagagatggcaaagcagcagttctaccaagcccattg

SEQ ID NO: 173299 - DNA, 758 bp, Homo sapiens
  Payload ID: 14064
  Gene Symbol: RAB6A
  Gene Name: RAB6A, member RAS oncogene family
  Uniprot ID: P20340
  ENST ID: ENST00000541588
  CDS Start-End: 440-754
actcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcgttggaaagacatctttgatcaccagattcatgtatgacagttttgacaacacctatcaggcaacaattggcattgactttttatcaaaaactatgtacttggaggatcgaacactctttcgacgtgtagcagcagctttgccgggaatggaaagcacacaggacagaagcagagaagatatgattgacataaaactggaaaagcctcaggagcaaccagtcagtgaaggaggctgttcctgctaatctc

SEQ ID NO: 173300 - DNA, 5526 bp, Homo sapiens
  Payload ID: 14065
  Gene Symbol: RAB6B
  Gene Name: RAB6B, member RAS oncogene family
  Uniprot ID: Q9NRW1
  ENST ID: ENST00000285208
  CDS Start-End: 351-977
ctcctccgccccgcgcgccgtccctgcgccccgctccgcccgcgcctctctcccagcgccgcgcctcgggcgtaaagagcgcgcccctcgcaccgcagccagtgccgaccgcagcagcccagccccagccttcctccgcctccgcctctctctcctcctcctcctccgccgccggacacgcagccgcaggccgggaccgggacgcagctggggagtcagggacgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcgtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcgaagactggctacaacgtgaagcagctttttcgacgtgtggcgtcggctctacccggaatggagaatgtccaggagaaaagcaaagaagggatgatcgacatcaagctggacaaaccccaggagcccccggccagcgagggcggctgctcctgctaatgcagagccgacctgtggcttcccatgacactccttgcttgttgtgttgcttcctattggctagcttcctaaggggggagggaaccgagttatcaagatgggaggatttttcttttctctctgtctttaggagtagggtgggatggggagggaggctgggcatcagggatcacatcactcttaacggctgttacttaaacaactattttttggtttggttgtaatatattgtactttattaagattgccaaaaactgttaaaatttaaaaaaaatttaaatcatgtgtatacaattttttgccagataaaaatgtagtcatttttatttgaaagatgtgctttttgtttttgtatatttgtaaacttatagagaaccttttccacacacctcctccttcctgttctctttgaaccattcatcacctctgccttcctcctatccccagcccaataaattaaaacaattaactgagcaaattaattaggcttcagtctggggccatctggccccactctctaggccctactccagttaaatcaaacattggttgaacacatcagcctctgaaaaggtagctctgactcttgtctttccatggccagagtgggtcgtcaacctcgtgtggagctgagaccaaggtctgtgggctctaggcagcccggcagcagcccccagaggaactgctcccacctctccttctctttccctgaaaagccttgaagggggttgagggtacaggcaaccttgtgttctctgtgccctcagggactggcagagcaagaggccatcagaaggacgaggtgctgttggcaattgcagctgcgtggtgcgtggtttatagactggggtgccatgtgtacttctgaaaatattttaaccagcccacccagcagtcagtacacatgcctgggccaagtctaagaaactcagtgtgtgatgttgggcagtgtgccatcctgaagccttcctcctggatgtcagggaagctggaccacctggagttgatcctctgtgatggggaggcgggggggggggggggtgttgtctgcagaaccaccaccttgaaagatccatgttcttagagcctcagctgctaatattgttgagtgctttctggaaaagctgatttgttgctatgttttcaccccagtggcatggcgcagttgaagtctttgtggacatatctttgtggctactgtggctgcgctgtggtcacctgaggatgtggttcaggtggggtctccagaaggctgcttgcccccagagagccatctcttccatttttgattcattcctgagaatggcttagtcctgagaatctgcaaagtctctgaagagaactctctcttcccactaagtgatataacctacttggccagcattccaaatagactcagactcactgccctgagcctgcacagagccaggtgcaatgggcagtgagtctggccaaaatgtaaaccccaccctccctgctgtcattggctctccctccaggctgctgctgggcatgtcatagatgggatgaatgaccatctggggtatggtgggctgaactccacaaggtcgttggaatgaattttgaaacttctcagaaattaatctgaaatggcaggcagtaagtgcagcagaatctggcaggactgatatttgtgcagtgggcctgccacacaccctctgcctaggaggctgtatgccagagctcatctctagcaaggaatttatcttcaggtgaagaagagaggaagcaggatcccactgagcacctcttgcagaaggcaaggaccaatgtttgaacgtgtttcagatgtcatgtgtttagtttttatatgtgtgtacataattatatatagagatagacttgtgtatacaccttccacaaacacatcctcacggagatacatgtgctcaatgtatattcttgtttctcctgctctcaagttggaacttgcattgtgataagttttggaaattcaaaagtactgcaacgtgttgaaataagaaatacttaatattgtcaaataacttgtgattgtcttgccatcaataaaataatgcatagttgtgttaaactacaggcaaacatagcccacgggaatatctccaccatttctctatgtactttatatgcacgggtgtgcatgcctgtgtgggccagtgtccccccaccatgggcacacccccaagtggtgcttgttggaagagtgcttacttacctcgagagaatttacaggagtccacatgacagtgtcctgcctggttggcagcgggggccatcacctgtggcctctgagaccgccccatttacaggaatctgcactgggtctcagtgaatgaacgtatggtagatttttattttcttggcactaaagattagcttttttaaaaaaacatcccataaaacagtagaaactcagttcccttctcaggggcacacacatccaaggcaccgtggactgtgtttccatcctggcctagaggagcagtaaaagatagcatttggtttgacatggccttagtgagtcctgcctttcctagcatgcacacaacatcctctctttgagtttgggttctccccagccccttggcctctgaggctgagggtggcttcctcccatcctcccatctcagtggttccatggcgctcccttcggcacgtgcggtttccgcccctcccttcctggggtgtggaaaggcagccagacctctttttcagaagttgttggttccctgatttttgtcttgagcaggcaccatccctgtccccttgcttgcaggtagaattggcacagagttaaggttccataataaactgttaggtgctcttgaagaagatgtcatggcattgcctcagcaccccagcaagagcattgcatctttgctgaatccagatgggttagcagagggcaaattggaggattcctttgaggaaatgttctcaattgagcaattcagtccctctccccaaagactagacgtgacctggcagattagcaggatcctcttggccttcttttttggggatggtgggagtgaagggggtgaatcttaaaagcttatcaacaaagctcctgttctgcaggcatcaggaaagttgagtgtaagatggaaaaagcaaacagcctatttacaagtggaaacacattggttctgatcactcctaacttgctgggtgatcatacatacatcaacatgaaggtgtgacatcagaatcatgagcaccatggctgcagttgtgtgatccaaggctagttggcttggtagctgttggcagcagtttcccttggtcagaggcctccttgctatctatcgctgctctcttcttgtcatccttaaacattcagtcatgttcccaggtctgaggggagcaatggccagaccagtttcagtatctctggcaacagaaacaaggattgaaatggtggtagttaagagtgcagacacatctggggtgcaacgtctgcatcatcctggtggctagccagtgcggggaggccctgccctgggataccagttgtgacaataaagggatggccctcctggcttcagcatcctgcaggtagagcagcctcattccttcacaagatggaaggcaggtgaggatgtcaggatgagatgggaccaggtagccgaggacagtgaggcatgtctgagccacttgaggggcagctgaacagaaggatgtctgtgtgcatcaaccgagcagattgtgcgcacactcgtttccgaactgcctctccccaaagaatgtgaggcattgtcaccttgttacagctatgtgaagcagagctgtcacaacttttcctgtctacaggcaggaaaaccaggatggagaagggcaacttgcttattaagatcacccagcaagttaggagtgatcagaaccagtgaagtttccatttttcatccattgctgccctgtgtgtgaacaaatgtgactccatatttattacacagcaaggactgctgtgtgtgggtgtgttcctcagaccatctctactctttttggttaggacactaggttcttcccagcatatgagtgagaatattggtggtattttgggctcctctactgcacaagggccagtccccaagtctactctgattgattgtcatgggcacccacacagatcaggacaccctttgaatttttgtttgacatgaactatttaggtgttccaaaaccttgggatctcaatgtgcaaactccttggactccagacccctgtctggttggcactcccagcagtgtgtggtttcatcaggaaatccttgcagcaggggtttagatggttccttcaggaggtgggaagcctccatagcattgaaggccagcctgcatctcgcggtgtgtgtccacttctcccctcactttcccctcacccatccctttaaagtgattggctgtgaggagcacagagggtggcaattccatctgttatgggctcagaagacatagccgccatgttgatttcacattaaactgtgtaaaatgtggaaaagactcagcatgttggtcaaacaataaactgtcctaattctcaaaa

SEQ ID NO: 173301 - DNA, 506 bp, Homo sapiens
  Payload ID: 14065
  Gene Symbol: RAB6B
  Gene Name: RAB6B, member RAS oncogene family
  ENST ID: ENST00000488969
  CDS Start-End: 358-506
gttagtctccttgctgcccagggatctgggcaattgcagtgagggctaccccaactcgaggcgatttggggaatgatacaggggcacctcacaccgagaggctgtgaagtctggctctgggcagagaaaggcccaggcgacacgccctgcctagcttcccagcactcctccagagagcatcggtggattcttcccacccccacctcccagctcaccgcccttcttgggggaggggaggtcaccctggcagtcggccagagctgggggagggggagactgcttctccgctgcccggctccctccccaggaaaacatctctgaaaaccagtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacat

SEQ ID NO: 173302 - DNA, 500 bp, Homo sapiens
  Payload ID: 14065
  Gene Symbol: RAB6B
  Gene Name: RAB6B, member RAS oncogene family
  ENST ID: ENST00000469959
  CDS Start-End: 168-383
ccgcaggccgggaccgggacgcagctggggagtcagggacgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcgtcgggaagacgtctctgattacgaggtgctgttggcaattgcagctgcgtggtgcgtggtttatagactggggtgccatgtgtacttctgaaaatattttaaccagcccacccagcagtcagtacacatgcctgggccaagtctaagaaactcagtgtgtgatgttgggcagtgtgccatcctgaagccttcctcctggatgtcagggaagctggaccacctggagttgatcctctgtgatggggaggcgggggggggggggg

SEQ ID NO: 173303 - DNA, 880 bp, Homo sapiens
  Payload ID: 14065
  Gene Symbol: RAB6B
  Gene Name: RAB6B, member RAS oncogene family
  Uniprot ID: Q9NRW1
  ENST ID: ENST00000486858
  CDS Start-End: 158-745
gagattttgggaatccactgagaaaattcaagttggtgttcttgggggagcagagcgtgccctgggttccctgactgctctggccttccatgggtgttctgcgggactgctggcagcccttccggactcctccctctctgctacctgctcaggttggatgtggcatatgaccagaaactggccattggtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcgaagactggctacaacgtgaagcagctttttcgacgtgtggcgtcggctctacccggaatggagaatgtccaggagaaaagcaaagaagggatgatcgacatcaagctggacaaaccccaggagcccccggccagcgagggcggctgctcctgctaatgcagagccgacctgtggcttcccatgacactccttgcttgttgtgttgcttcctattggctagcttcctaaggggggagggaaccgagttatcaagatgggaggatttttcttttctctctgtctttaggagta

SEQ ID NO: 173304 - DNA, 723 bp, Homo sapiens
  Payload ID: 14065
  Gene Symbol: RAB6B
  Gene Name: RAB6B, member RAS oncogene family
  ENST ID: ENST00000460865
  CDS Start-End: 474-723
tggcgcggctctggagagcgctcctccgccccgcgcgccgtccctgcgccccgctccgcccgcgcctctctcccagcgccgcgcctcgggcgtaaagagcgcgcccctcgcaccgcagccagtgccgaccgcagcagcccagccccagccttcctccgcctccgcctctctctcctcctcctcctccgccgccggacacgcagccgcaggccgggaccgggacgcagctggggagtcagggacgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataacca

SEQ ID NO: 173305 - DNA, 586 bp, Homo sapiens
  Payload ID: 14065
  Gene Symbol: RAB6B
  Gene Name: RAB6B, member RAS oncogene family
  ENST ID: ENST00000477759
  CDS Start-End: 215-586
cggccccggctgccagcaccatgtccgcagggggagattttgggaatccactgagaaaattcaagttggtgttcttgggggagcagagcgtgccctgggttccctgactgctctggccttccatgggtgttctgcgggactgctggcagcccttccggactcctccctctctgctacctgctcagtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcg

SEQ ID NO: 173306 - DNA, 5219 bp, Homo sapiens
  Payload ID: 14065
  Gene Symbol: RAB6B
  Gene Name: RAB6B, member RAS oncogene family
  Uniprot ID: Q9NRW1
  ENST ID: ENST00000543906
  CDS Start-End: 130-756
acgcgcgcagccagcccttccccctccggctcccgcaccgccggccgcctcccctcgccctcctactctcccctccctgctccttcgctttttcctcctcctcctctcccggccccggctgccagcaccatgtccgcagggggagattttgggaatccactgagaaaattcaagttggtgttcttgggggagcagagcgtcgggaagacgtctctgattacgaggttcatgtacgacagcttcgacaacacataccaggcaaccattgggattgacttcttgtcaaaaaccatgtacttggaggaccgcacggtgcgactgcagctctgggacacagctggtcaggagaggttccgcagcctgatccccagctacatccgggactccacggtggctgtggtggtgtacgacatcacaaatctcaactccttccaacagacctctaagtggatcgacgacgtcaggacagagaggggcagtgatgttatcatcatgctggtgggcaacaagacggacctggctgataagaggcagataaccatcgaggagggggagcagcgcgccaaagaactgagcgtcatgttcattgagaccagtgcgaagactggctacaacgtgaagcagctttttcgacgtgtggcgtcggctctacccggaatggagaatgtccaggagaaaagcaaagaagggatgatcgacatcaagctggacaaaccccaggagcccccggccagcgagggcggctgctcctgctaatgcagagccgacctgtggcttcccatgacactccttgcttgttgtgttgcttcctattggctagcttcctaaggggggagggaaccgagttatcaagatgggaggatttttcttttctctctgtctttaggagtagggtgggatggggagggaggctgggcatcagggatcacatcactcttaacggctgttacttaaacaactattttttggtttggttgtaatatattgtactttattaagattgccaaaaactgttaaaatttaaaaaaaatttaaatcatgtgtatacaattttttgccagataaaaatgtagtcatttttatttgaaagatgtgctttttgtttttgtatatttgtaaacttatagagaaccttttccacacacctcctccttcctgttctctttgaaccattcatcacctctgccttcctcctatccccagcccaataaattaaaacaattaactgagcaaattaattaggcttcagtctggggccatctggccccactctctaggccctactccagttaaatcaaacattggttgaacacatcagcctctgaaaaggtagctctgactcttgtctttccatggccagagtgggtcgtcaacctcgtgtggagctgagaccaaggtctgtgggctctaggcagcccggcagcagcccccagaggaactgctcccacctctccttctctttccctgaaaagccttgaagggggttgagggtacaggcaaccttgtgttctctgtgccctcagggactggcagagcaagaggccatcagaaggacgaggtgctgttggcaattgcagctgcgtggtgcgtggtttatagactggggtgccatgtgtacttctgaaaatattttaaccagcccacccagcagtcagtacacatgcctgggccaagtctaagaaactcagtgtgtgatgttgggcagtgtgccatcctgaagccttcctcctggatgtcagggaagctggaccacctggagttgatcctctgtgatggggaggcgggggggggggggggtgttgtctgcagaaccaccaccttgaaagatccatgttcttagagcctcagctgctaatattgttgagtgctttctggaaaagctgatttgttgctatgttttcaccccagtggcatggcgcagttgaagtctttgtggacatatctttgtggctactgtggctgcgctgtggtcacctgaggatgtggttcaggtggggtctccagaaggctgcttgcccccagagagccatctcttccatttttgattcattcctgagaatggcttagtcctgagaatctgcaaagtctctgaagagaactctctcttcccactaagtgagtctggccaaaatgtaaaccccaccctccctgctgtcattggctctccctccaggctgctgctgggcatgtcatagatgggatgaatgaccatctggggtatggtgggctgaactccacaaggtcgttggaatgaattttgaaacttctcagaaattaatctgaaatggcaggcagtaagtgcagcagaatctggcaggactgatatttgtgcagtgggcctgccacacaccctctgcctaggaggctgtatgccagagctcatctctagcaaggaatttatcttcaggtgaagaagagaggaagcaggatcccactgagcacctcttgcagaaggcaaggaccaatgtttgaacgtgtttcagatgtcatgtgtttagtttttatatgtgtgtacataattatatatagagatagacttgtgtatacaccttccacaaacacatcctcacggagatacatgtgctcaatgtatattcttgtttctcctgctctcaagttggaacttgcattgtgataagttttggaaattcaaaagtactgcaacgtgttgaaataagaaatacttaatattgtcaaataacttgtgattgtcttgccatcaataaaataatgcatagttgtgttaaactacaggcaaacatagcccacgggaatatctccaccatttctctatgtactttatatgcacgggtgtgcatgcctgtgtgggccagtgtccccccaccatgggcacacccccaagtggtgcttgttggaagagtgcttacttacctcgagagaatttacaggagtccacatgacagtgtcctgcctggttggcagcgggggccatcacctgtggcctctgagaccgccccatttacaggaatctgcactgggtctcagtgaatgaacgtatggtagatttttattttcttggcactaaagattagcttttttaaaaaaacatcccataaaacagtagaaactcagttcccttctcaggggcacacacatccaaggcaccgtggactgtgtttccatcctggcctagaggagcagtaaaagatagcatttggtttgacatggccttagtgagtcctgcctttcctagcatgcacacaacatcctctctttgagtttgggttctccccagccccttggcctctgaggctgagggtggcttcctcccatcctcccatctcagtggttccatggcgctcccttcggcacgtgcggtttccgcccctcccttcctggggtgtggaaaggcagccagacctctttttcagaagttgttggttccctgatttttgtcttgagcaggcaccatccctgtccccttgcttgcaggtagaattggcacagagttaaggttccataataaactgttaggtgctcttgaagaagatgtcatggcattgcctcagcaccccagcaagagcattgcatctttgctgaatccagatgggttagcagagggcaaattggaggattcctttgaggaaatgttctcaattgagcaattcagtccctctccccaaagactagacgtgacctggcagattagcaggatcctcttggccttcttttttggggatggtgggagtgaagggggtgaatcttaaaagcttatcaacaaagctcctgttctgcaggcatcaggaaagttgagtgtaagatggaaaaagcaaacagcctatttacaagtggaaacacattggttctgatcactcctaacttgctgggtgatcatacatacatcaacatgaaggtgtgacatcagaatcatgagcaccatggctgcagttgtgtgatccaaggctagttggcttggtagctgttggcagcagtttcccttggtcagaggcctccttgctatctatcgctgctctcttcttgtcatccttaaacattcagtcatgttcccaggtctgaggggagcaatggccagaccagtttcagtatctctggcaacagaaacaaggattgaaatggtggtagttaagagtgcagacacatctggggtgcaacgtctgcatcatcctggtggctagccagtgcggggaggccctgccctgggataccagttgtgacaataaagggatggccctcctggcttcagcatcctgcaggtagagcagcctcattccttcacaagatggaaggcaggtgaggatgtcaggatgagatgggaccaggtagccgaggacagtgaggcatgtctgagccacttgaggggcagctgaacagaaggatgtctgtgtgcatcaaccgagcagattgtgcgcacactcgtttccgaactgcctctccccaaagaatgtgaggcattgtcaccttgttacagctatgtgaagcagagctgtcacaacttttcctgtctacaggcaggaaaaccaggatggagaagggcaacttgcttattaagatcacccagcaagttaggagtgatcagaaccagtgaagtttccatttttcatccattgctgccctgtgtgtgaacaaatgtgactccatatttattacacagcaaggactgctgtgtgtgggtgtgttcctcagaccatctctactctttttggttaggacactaggttcttcccagcatatgagtgagaatattggtggtattttgggctcctctactgcacaagggccagtccccaagtctactctgattgattgtcatgggcacccacacagatcaggacaccctttgaatttttgtttgacatgaactatttaggtgttccaaaaccttgggatctcaatgtgcaaactccttggactccagacccctgtctggttggcactcccagcagtgtgtggtttcatcaggaaatccttgcagcaggggtttagatggttccttcaggaggtgggaagcctccatagcattgaaggccagcctgcatctcgcggtgtgtgtccacttctcccctcactttcccctcacccatccctttaaagtgattggctgtgaggagcacagagggtggcaattccatctgttatgggctcagaagacatagccgccatgttgatttcacattaaactgtgtaaaatgtggaaaagactcagcatgttggtcaaacaataaactgtcctaattctc

SEQ ID NO: 173307 - DNA, 3075 bp, Homo sapiens
  Payload ID: 14066
  Gene Symbol: RAB6C
  Gene Name: RAB6C, member RAS oncogene family
  Uniprot ID: Q9H0N0
  ENST ID: ENST00000410061
  CDS Start-End: 453-1217
gcactcagcaggttgggctgcggcggcggcggctggggaagccgaagcgccgcgcgtgagagatcccggatacatctgcggtttgggctccgccaccctccgtctctctcccgcaggtctctgagccgggtgcggaaggagggaacggccctagccttgggaagccaaagcacacccctggctcctgccgacaccgccctccttcccttcccagccgcgggcctcgctccgtgctcggctactctgccgggaggcggcggcggctgccagtctgtggcgagccctgctgccctccagccgggctcctccagccgggctcctccaccggcccttgcaggggcgcagagagctcggcgcccgcccttccgctcgcctttttcgtcagccggctggaggagcatcggtccgggaggtctctgggctgaggcggcgacagctcctctagttccaccatgtccgcgggcggagacttcgggaatccgctgaggaaattcaagctggtgttcctgggggagcaaagcgttgcaaagacatctttgatcaccagattcaggtatgacagttttgacaacacctatcaggcaataattggcattgactttttatcaaaaactatgtacttggaggatggaacaatcgggcttcggctgtgggatacggcgggtcaggaacgtctccgtagcctcattcccaggtacatccgtgattctgctgcagctgtagtagtttacgatatcacaaatgttaactcattccagcaaactacaaagtggattgatgatgtcagaacagaaagaggaagtgatgttatcatcacgctagtaggaaatagaacagatcttgctgacaagaggcaagtgtcagttgaggagggagagaggaaagccaaagggctgaatgttacgtttattgaaactagggcaaaagctggatacaatgtaaagcagctctttcgacgtgtagcagcagctttgccgggaatggaaagcacacaggacggaagcagagaagacatgagtgacataaaactggaaaagcctcaggagcaaacagtcagcgaagggggttgttcctgctactctcccatgtcatcttcaacccttcctcagaagcccccttactctttcattgactgcagtgtgaatattggcttgaaccttttcccttcattaataacgttttgcaattcatcattgctgcctgtctcgtggaggtgatctattagcttcacaagcacaaaaaaagtcagcgtcttcattatttatattttacaaaaagccaaattatttcagcatattccggtgataactttaaaaattagatacattttcttaacatttttttcttttttaatgttatgataatgtacttcaaaatgatggaaatctcaacagtatgagtatggcttggttaacgagcagtatgttcacagcctgctttatctctccttgctcttctcacctctcccttaccccgttccctatttccgtgttcttacctagcctccccccacttcctcaaaacaaacaagagatggcaaagcagcagtccgaccaagcccactggaattatcctttaattttacagataccacttgctgtaggctgtggaccaagatgtccagaattattcttgagcactgatgtaaattacttagatcttctttgaggtcagaattcagcgatcacggtaggcagtgcttgaatgagaaaagcctcctggtgcatcttcaaaatgagtcctaaagaacatactgagtacttataagtagcagaacataaaatgtatttctgactaacacaaatggtcctttcacatgtgctttattagactctgggagagaaaagtaaccaagtgcttcagaacaggtttttagtatttacttcttcatggtaagataatgaagttctaatgaactatttctcccaaggttttaaaattgtcaagagttattctgtttgtttaaaaagtaagaaacctctgtaagcaatagattttgcttgggttttctttcttaaaaaaataatactatgcaggcaagacaccataaaagtttaattccttacagaagaaccagtggaagaatttaaatttggcactacgatcaaaactactgaattagcagaaataacgatatctaaagcttaccagcaaaagaaccctcagcagaatagcaaaaactttgctcaggacatttgaggtcaaattgaagacggaagacggaagacggaaaccggaaaccgttttcttgtaagcccctagaggcagatcaggtaaagcatacatagtagagggaaaggagagaatggaaataaaactgaatattatgcagatttatgccttattttttagcattttttaaggttgggtctttcaggctggttttggtttgtattagatctgtatagtttaactagtgatttagttttatatttaagctacgattaatattttttctttggcgatatttctttgctttttttttttttaacaactttccatttttagatgtttcgttgaatctatttagagcttcaccatggcaatatgtatttcccttaaaacactgcaaacaaatatactaggagtgtgcccttttaatctttactagttattgtgagattgctgtgtaagctaataaacacatttgtaaatacattgtttgcaggaagaaaacttcgagttacaggtcaggaaaagcctgctgaatttatgttgtaaacgttacttaacacagtataaagatgaaaagacaacaaaagtatcttcatacttcctcatcccctcattgcaacaaaaccttaaactgggagaaccttagtcccctctctttcctcttcctcctccacttcccacttattgtcactttgtaatattcagagagcacttggattatggatctgaatagagaaatgcttacagataatcattagcccacataccagtaacttatacttaaagatgggatggagttataaagtgcttttataatacaatataattgctaaaggcaagggttgactctttgttttattttgacatggcatgtcctgaaataaatattgattcactatg

SEQ ID NO: 173308 - DNA, 2244 bp, Homo sapiens
  Payload ID: 14067
  Gene Symbol: RAB7A
  Gene Name: RAB7A, member RAS oncogene family
  Uniprot ID: P51149
  ENST ID: ENST00000265062
  CDS Start-End: 247-870
gtctcgtgacaggtacttccgctcggggcggcggcggtggcggaagtgggagcgggcctggagtcttggccataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaagagtgaaaggaaaaccctaacagatctgtcctagtgattttacctttgttctagaaggcgctcctttcagggttgtggtattcttaggttagcggagctttttcctcttttccccacccatctccccaatattgcccattattaattaacctctttctttggttggaaccctggcagttctgctcccttcctaggatctgcccctgcattgtagcttgcttaacggagcacttctcctttttccaaaggtctacattctagggtgtgggctgagttcttctgtaaagagatgaacgcaatgccaataaaattgaacaagaacaatg

SEQ ID NO: 173309 - DNA, 533 bp, Homo sapiens
  Payload ID: 14067
  Gene Symbol: RAB7A
  Gene Name: RAB7A, member RAS oncogene family
  ENST ID: ENST00000483906
  CDS Start-End: 10-414
gtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcaggtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgc

SEQ ID NO: 173310 - DNA, 329 bp, Homo sapiens
  Payload ID: 14067
  Gene Symbol: RAB7A
  Gene Name: RAB7A, member RAS oncogene family
  ENST ID: ENST00000493186
  CDS Start-End: 10-306
gtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcaca

SEQ ID NO: 173311 - DNA, 1589 bp, Homo sapiens
  Payload ID: 14067
  Gene Symbol: RAB7A
  Gene Name: RAB7A, member RAS oncogene family
  ENST ID: ENST00000482525
  CDS Start-End: 176-658
ataaagcctgaggcggcggcagcggcggagttggcggcttggagagctcgggagagttccctggaaccagaacttggaccttctcgcttctgtcctccgtttagtctcctcctcggcgggagccctcgcgacgcgcccggcccggagcccccagcgcagcggccgcgtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtggccacaaagcgggcacaggcctggtgctacagcaaaaacaacattccctactttgagaccagtgccaaggaggccatcaacgtggagcaggcgttccagacgattgcacggaatgcacttaagcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcccttgcccgtgatggctccttggggtctgcctgcccacccacatgagcccgcgagtatggcagcaggacaagccagcggtggaagtcattctgatatggagttggcattggaagcttattctttttgttcactggagagagagagaactgtttacagttaatctgtgtctaattatctgattttttttattggtcttgtggtctttttaccccccctttcccctccctccttgaaggctaccccttgggaaggctggtgccccatgccccattacaggctcacacccagtctgatcaggctgagttttgtatgtatctatctgttaatgcttgttacttttaactaatcagatctttttacagtatccatttattatgtaatgcttcttagaaaagaatcttatagtacatgttaatatatgcaaccaattaaaatgtataaattagtgtaagaaattcttggattatgtgtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttcccttctgtgtctaaattttccaaaacgttgatttgcataatacagt

SEQ ID NO: 173312 - DNA, 576 bp, Homo sapiens
  Payload ID: 14067
  Gene Symbol: RAB7A
  Gene Name: RAB7A, member RAS oncogene family
  ENST ID: ENST00000464496
  CDS Start-End: 126-576
tagcaggaaggttcagggccctgcactgttggggctgctcagacatttgtgcaagggaggtgttttgttttggtgtttccatcacactcacagtgatttctccttttccccctttagtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacattcaaaaccctagatagctggagagatgagtttctcatccaggccagtccccgagatcctgaaaacttcccatttgttgtgttgggaaacaagattgacctcgaaaacagacaagtggccacaaagcgggcacaggcctggtgctacagcaaaaacaacattccct

SEQ ID NO: 173313 - DNA, 507 bp, Homo sapiens
  Payload ID: 14067
  Gene Symbol: RAB7A
  Gene Name: RAB7A, member RAS oncogene family
  ENST ID: ENST00000485280
  CDS Start-End: 10-285
gtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcaggaaacggaggtggagctgtacaacgaatttcctgaacctatcaaactggacaagaatgaccgggccaaggcctcggcagaaagctgcagttgctgagggggcagtgagagttgagcacagagtccttcacaaaccaagaacacacgtaggccttcaacacaattcccctctcctcttccaaacaaaacatacattgatctctcacatccagctgccaaaagaaaaccccatcaaacacagttacaccccacatatctctcacacacacacacacacgcacacacacacacacagatctgacgtaatcaaactccagcc

SEQ ID NO: 173314 - DNA, 359 bp, Homo sapiens
  Payload ID: 14067
  Gene Symbol: RAB7A
  Gene Name: RAB7A, member RAS oncogene family
  ENST ID: ENST00000490093
  CDS Start-End: 10-359
gtttgaaggatgacctctaggaagaaagtgttgctgaaggttatcatcctgggagattctggagtcgggaagacatcactcatgaaccagtatgtgaataagaaattcagcaatcagtacaaagccacaataggagctgactttctgaccaaggaggtgatggtggatgacaggctagtcacaatgcagatatgggacacagcaggacaggaacggttccagtctctcggtgtggccttctacagaggtgcagactgctgcgttctggtatttgatgtgactgcccccaacacaaagcgggcacaggcctggtgctacagcaaaaacaacattccctactttgagaccagtgccaagga

SEQ ID NO: 173315 - DNA, 3014 bp, Homo sapiens
  Payload ID: 14068
  Gene Symbol: RAB7B
  Gene Name: RAB7B, member RAS oncogene family
  Uniprot ID: Q96AH8
  ENST ID: ENST00000617991
  CDS Start-End: 305-904
tggcactccaggctgcctccaagagcagggttggtagagctgagggatgagagatttgcctgtcctggagagtcaccacccttccagctttggggaggcccccagggaaagtgagggagaagatatatgaagattgctgaattacgtgcctccttcggagaaccccacccagtcccgggcccagggcagtaacttgcccattggaaaggggaaagcagaggccacactcagtgacaatggccacaaggaacattggctagcatgtggatgacctctgtttccttacaggctctgaagcccttccatgaatccccggaagaaggtggacctgaaactcattatcgtcggagccattggtgtgggaaagacctccctccttcaccaatatgtgcacaagacgttttatgaggaataccagaccacactgggggccagcatcctctccaagattatcatattgggtgacacaactttgaagttacagatctgggacacgggcggtcaggagcggttccgctccatggtgtccacgttctacaagggctccgatggctgcatcctagcttttgatgtcaccgacctggagtcttttgaagccctggatatctggcggggtgatgtcctggccaagattgtccccatggagcagtcctaccccatggtgttgttggggaacaagatcgatctggcagaccggaaggtaccccaggaagtagctcaaggctggtgtagagagaaagatattccttactttgaagtcagtgccaagaatgacatcaatgtggtgcaagcgtttgagatgctggccagtagggctctgtcgaggtaccagagcatcttagaaaatcacctcacagaatccatcaagctctcgccagaccagtcaaggagcagatgctgctgacctccagacgcctgctctggaagcccagaaacagagcctgccccgagcctggtcaccccaggcttgagaacaggtgaccatccccctccagccccactgcctgcccaagcacagtgcagggggcctaagctctgcggcagagcccttgaccctggtgctgggcccagagtcagagggcagcccctggctcaggctgagtatagtgagagcgtctggatgaagcccggaatgtcagagccaaaccctggtcctgcagaagtcaccgtttccgcagtggctccagctttccccacccatccacccctcaaacactcccgctccagaacacacatctccgcagaccggccactgattggagtctggttacatcctcctgtggacagaccttcctcacccgctcccacctcacacccctcagccacaagcaaagctttggacaatggcacagctcagcctccttcaacgagcagactaaggagtaaaggtctggaccccacatgctgggcccgcctcagctcctggcagaagctgtcgtgcctgagaccccctctgctccctccagggtagaagactgagggagcacaggagaagccacaagggaccatggctcattcctccttgctgggtgctcaggcaactcacataaatctctgagtctcaatttgtttatctgtcctgtgggggtgagatgtgccttgccccctgtatcacagtgtggttttgaggaccagaagctgtgcttaaatccagtagctgttgtcaatatgcatttatttacttctttgacaagtttatttttgcgtatctactatgtacgatgcattgaagtccagtgacaaacaaaacacagggactctgccctcctggagccgacatctggtgagggagagacgcagactctagacagatatttccaaatagcaggtaagtgctataaacaaagggaaacagggtaatgggatagagtgacagggggtgggatgagttgctattttagatgaagtggtccaggagggcttccctgaggaggtggcatttggtctgagggctagagaatgagaaagcagctgtcacctgagagctggagaaagaacattccagggagagggagcatcaagacccaaagccctgaggcaaaaacaagcttgccatgttccaggaacagtgaaaggacatccattgacctaatactcaaagctgctgtcccaaagacaaagcaaaggggacccagctcccttgggtggctcctagatgctctgctgcctgaccaccagagggcagcagtgctccttctcttccaggctgagcagaaagtggatgctcatgaaggttttaggagctggggttttgtccttcagatgctcaaagcttgttcatgggcttggaggcatgtttagccctttgggatttgtaaggcagagaattccaatttcttaagcctagtaagaaatgagcaaaaacttcaatatatatgactcaggcaagaaatcagcatctgtggcaaatactagaatgaaatgcaagaaagctcactgcaaggagtctccctccctgcagattccaaggctggaatctttttcttctggctccaggcagcacagacagggcctagcctggagagggtggacaagatgtcctctcagggtcttcaatggccaagtccatgcccactgcagaatctttctgtctacccgtaagtatcctttcctgagttccaggcaaagctggggatgttagcctatgactgtcatctgacttggaaggtacacctaggggccggggggaggtcagcaggggagtttgggagccacttctccccccacgtggcactggagtgtgaactggctcattctggacaccagcatggagccagcacgggaacaggggggcagcctagagcacaagctctatctgtgtccttcagagctcctgggaaacatgatgcgccctcatgggaatggcattttgcatatcacacaggctgtcctgggagtcaggcagactggattgtcacgtgcggtgtgcatgcagcagcttgtgcactgcagtggacctgtggaccatttctaaaggtgcacaacaaataataaatgtgtccttctttgttttt

SEQ ID NO: 173316 - DNA, 2888 bp, Homo sapiens
  Payload ID: 14068
  Gene Symbol: RAB7B
  Gene Name: RAB7B, member RAS oncogene family
  Uniprot ID: Q96AH8
  ENST ID: ENST00000617070
  CDS Start-End: 178-777
gggaagtggcgtggcttcaacagactttcttttgcctgtctttgtcccagagcctcttccctggccctgctgagaccactgctctaagaagagaccaccagactgagagaggactcccagctgccctcagagcggaggccgagtgctgcacagccacagctgctctgaagcccttccatgaatccccggaagaaggtggacctgaaactcattatcgtcggagccattggtgtgggaaagacctccctccttcaccaatatgtgcacaagacgttttatgaggaataccagaccacactgggggccagcatcctctccaagattatcatattgggtgacacaactttgaagttacagatctgggacacgggcggtcaggagcggttccgctccatggtgtccacgttctacaagggctccgatggctgcatcctagcttttgatgtcaccgacctggagtcttttgaagccctggatatctggcggggtgatgtcctggccaagattgtccccatggagcagtcctaccccatggtgttgttggggaacaagatcgatctggcagaccggaaggtaccccaggaagtagctcaaggctggtgtagagagaaagatattccttactttgaagtcagtgccaagaatgacatcaatgtggtgcaagcgtttgagatgctggccagtagggctctgtcgaggtaccagagcatcttagaaaatcacctcacagaatccatcaagctctcgccagaccagtcaaggagcagatgctgctgacctccagacgcctgctctggaagcccagaaacagagcctgccccgagcctggtcaccccaggcttgagaacaggtgaccatccccctccagccccactgcctgcccaagcacagtgcagggggcctaagctctgcggcagagcccttgaccctggtgctgggcccagagtcagagggcagcccctggctcaggctgagtatagtgagagcgtctggatgaagcccggaatgtcagagccaaaccctggtcctgcagaagtcaccgtttccgcagtggctccagctttccccacccatccacccctcaaacactcccgctccagaacacacatctccgcagaccggccactgattggagtctggttacatcctcctgtggacagaccttcctcacccgctcccacctcacacccctcagccacaagcaaagctttggacaatggcacagctcagcctccttcaacgagcagactaaggagtaaaggtctggaccccacatgctgggcccgcctcagctcctggcagaagctgtcgtgcctgagaccccctctgctccctccagggtagaagactgagggagcacaggagaagccacaagggaccatggctcattcctccttgctgggtgctcaggcaactcacataaatctctgagtctcaatttgtttatctgtcctgtgggggtgagatgtgccttgccccctgtatcacagtgtggttttgaggaccagaagctgtgcttaaatccagtagctgttgtcaatatgcatttatttacttctttgacaagtttatttttgcgtatctactatgtacgatgcattgaagtccagtgacaaacaaaacacagggactctgccctcctggagccgacatctggtgagggagagacgcagactctagacagatatttccaaatagcaggtaagtgctataaacaaagggaaacagggtaatgggatagagtgacagggggtgggatgagttgctattttagatgaagtggtccaggagggcttccctgaggaggtggcatttggtctgagggctagagaatgagaaagcagctgtcacctgagagctggagaaagaacattccagggagagggagcatcaagacccaaagccctgaggcaaaaacaagcttgccatgttccaggaacagtgaaaggacatccattgacctaatactcaaagctgctgtcccaaagacaaagcaaaggggacccagctcccttgggtggctcctagatgctctgctgcctgaccaccagagggcagcagtgctccttctcttccaggctgagcagaaagtggatgctcatgaaggttttaggagctggggttttgtccttcagatgctcaaagcttgttcatgggcttggaggcatgtttagccctttgggatttgtaaggcagagaattccaatttcttaagcctagtaagaaatgagcaaaaacttcaatatatatgactcaggcaagaaatcagcatctgtggcaaatactagaatgaaatgcaagaaagctcactgcaaggagtctccctccctgcagattccaaggctggaatctttttcttctggctccaggcagcacagacagggcctagcctggagagggtggacaagatgtcctctcagggtcttcaatggccaagtccatgcccactgcagaatctttctgtctacccgtaagtatcctttcctgagttccaggcaaagctggggatgttagcctatgactgtcatctgacttggaaggtacacctaggggccggggggaggtcagcaggggagtttgggagccacttctccccccacgtggcactggagtgtgaactggctcattctggacaccagcatggagccagcacgggaacaggggggcagcctagagcacaagctctatctgtgtccttcagagctcctgggaaacatgatgcgccctcatgggaatggcattttgcatatcacacaggctgtcctgggagtcaggcagactggattgtcacgtgcggtgtgcatgcagcagcttgtgcactgcagtggacctgtggaccatttctaaaggtgcacaacaaataataaatgtgtccttctttgttttta

SEQ ID NO: 173317 - DNA, 1851 bp, Homo sapiens
  Payload ID: 14068
  Gene Symbol: RAB7B
  Gene Name: RAB7B, member RAS oncogene family
  ENST ID: ENST00000623893
  CDS Start-End: 226-699
gcaactttcccaagtctgtgcacgagagggagaggaggaaaactcagagggaagtggcgtggcttcaacagactttcttttgcctgtctttgtcccagagcctcttccctggccctgctgagaccactgctctaagaagagaccaccagactgagagaggactcccagctgccctcagagcggaggccgagtgctgcacagccacagctgctctgaagcccttccatgaatccccggaagaaggtggacctgaaactcattatcgtcggagccattggtgtgggaaagacctccctccttcaccaatatgtgcacaagacgttttatgaggaataccagaccacactgggggccagcatcctctccaagattatcatattgggtgacacaactttgaagttacagatctgggacacgggcggtcaggagcggttccgctccatggtgtccacgttctacaagggctccgatggctgcatcctagcttttgatgtcaccgacctggagtcttttgaagccctggatatctggcggggtgatgtcctggccaagattgtccccatggagcagtcctaccccatggtgttgttggggaacaagatcgatctggcagaccggaagtaccagagcatcttagaaaatcacctcacagaatccatcaagctctcgccagaccagtcaaggagcagatgctgctgacctccagacgcctgctctggaagcccagaaacagagcctgccccgagcctggtcaccccaggcttgagaacaggtgaccatccccctccagccccactgcctgcccaagcacagtgcagggggcctaagctctgcggcagagcccttgaccctggtgctgggcccagagtcagagggcagcccctggctcaggctgagtatagtgagagcgtctggatgaagcccggaatgtcagagccaaaccctggtcctgcagaagtcaccgtttccgcagtggctccagctttccccacccatccacccctcaaacactcccgctccagaacacacatctccgcagaccggccactgattggagtctggttacatcctcctgtggacagaccttcctcacccgctcccacctcacacccctcagccacaagcaaagctttggacaatggcacagctcagcctccttcaacgagcagactaaggagtaaaggtctggaccccacatgctgggcccgcctcagctcctggcagaagctgtcgtgcctgagaccccctctgctccctccagggtagaagactgagggagcacaggagaagccacaagggaccatggctcattcctccttgctgggtgctcaggcaactcacataaatctctgagtctcaatttgtttatctgtcctgtgggggtgagatgtgccttgccccctgtatcacagtgtggttttgaggaccagaagctgtgcttaaatccagtagctgttgtcaatatgcatttatttacttctttgacaagtttatttttgcgtatctactatgtacgatgcattgaagtccagtgacaaacaaaacacagggactctgccctcctggagccgacatctggtgagggagagacgcagactctagacagatatttccaaatagcaggtaagtgctataaacaaagggaaacagggtaatgggatagagtgacagggggtgggatgagttgctattttagatgaagtggtccaggagggcttccctgaggaggtggcatttggtctgagggctagagaatgagaaagcagctgtcacctgagagctggagaaagaacattccagggagagggagcatcaagacccaaagccctgaggcaaaaacaagcttgccat

SEQ ID NO: 173318 - DNA, 2330 bp, Homo sapiens
  Payload ID: 14068
  Gene Symbol: RAB7B
  Gene Name: RAB7B, member RAS oncogene family
  Uniprot ID: Q96AH8
  ENST ID: ENST00000623597
  CDS Start-End: 289-888
ctccaagagcagggttggtagagctgagggatgagagatttgcctgtcctggagagtcaccacccttccagctttggggaggcccccagggaaagtgagggagaagatatatgaagattgctgaattacgtgcctccttcggagaaccccacccagtcccgggcccagggcagtaacttgcccattggaaaggggaaagcagaggccacactcagtgacaatggccacaaggaacattggctagcatgtggatgacctctgtttccttacaggctctgaagcccttccatgaatccccggaagaaggtggacctgaaactcattatcgtcggagccattggtgtgggaaagacctccctccttcaccaatatgtgcacaagacgttttatgaggaataccagaccacactgggggccagcatcctctccaagattatcatattgggtgacacaactttgaagttacagatctgggacacgggcggtcaggagcggttccgctccatggtgtccacgttctacaagggctccgatggctgcatcctagcttttgatgtcaccgacctggagtcttttgaagccctggatatctggcggggtgatgtcctggccaagattgtccccatggagcagtcctaccccatggtgttgttggggaacaagatcgatctggcagaccggaaggtaccccaggaagtagctcaaggctggtgtagagagaaagatattccttactttgaagtcagtgccaagaatgacatcaatgtggtgcaagcgtttgagatgctggccagtagggctctgtcgaggtaccagagcatcttagaaaatcacctcacagaatccatcaagctctcgccagaccagtcaaggagcagatgctgctgacctccagacgcctgctctggaagcccagaaacagagcctgccccgagcctggtcaccccaggcttgagaacaggtgaccatccccctccagccccactgcctgcccaagcacagtgcagggggcctaagctctgcggcagagcccttgaccctggtgctgggcccagagtcagagggcagcccctggctcaggctgagtatagtgagagcgtctggatgaagcccggaatgtcagagccaaaccctggtcctgcagaagtcaccgtttccgcagtggctccagctttccccacccatccacccctcaaacactcccgctccagaacacacatctccgcagaccggccactgattggagtctggttacatcctcctgtggacagaccttcctcacccgctcccacctcacacccctcagccacaagcaaagctttggacaatggcacagctcagcctccttcaacgagcagactaaggagtaaaggtctggaccccacatgctgggcccgcctcagctcctggcagaagctgtcgtgcctgagaccccctctgctccctccagggtagaagactgagggagcacaggagaagccacaagggaccatggctcattcctccttgctgggtgctcaggcaactcacataaatctctgagtctcaatttgtttatctgtcctgtgggggtgagatgtgccttgccccctgtatcacagtgtggttttgaggaccagaagctgtgcttaaatccagtagctgttgtcaatatgcatttatttacttctttgacaagtttatttttgcgtatctactatgtacgatgcattgaagtccagtgacaaacaaaacacagggactctgccctcctggagccgacatctggtgagggagagacgcagactctagacagatatttccaaatagcaggcagcacagacagggcctagcctggagagggtggacaagatgtcctctcagggtcttcaatggccaagtccatgcccactgcagaatctttctgtctacccgtaagtatcctttcctgagttccaggcaaagctggggatgttagcctatgactgtcatctgacttggaaggtacacctaggggccggggggaggtcagcaggggagtttgggagccacttctccccccacgtggcactggagtgtgaactggctcattctggacaccagcatggagccagcacgggaacaggggggcagcctagagcacaagctctatctgtgtccttcagagctcctgggaaacatgatgcgccctcatgggaatggcattttgcatatcacacaggctgtcctgggagtcaggcagactggattgtcacgtgcggtgtgcatgcagcagcttgtgcactgcagtggacctgtggaccatttctaaaggtgcacaacaaataataaatgtgtccttctttgttttt

SEQ ID NO: 173319 - DNA, 689 bp, Homo sapiens
  Payload ID: 14068
  Gene Symbol: RAB7B
  Gene Name: RAB7B, member RAS oncogene family
  ENST ID: ENST00000622969
  CDS Start-End: 1-275
tggatatctggcggggtgatgtcctggccaagattgtccccatggagcagtcctaccccatggtgttgttggggaacaagatcgatctggcagaccggaaggtaccccaggaagtagctcaaggctggtgtagagagaaagatattccttactttgaagtcagtgccaagaatgacatcaatgtggtgcaagcgtttgagatgctggccagtagggctctgtcgaggccctcactgtctcgggaaaggaaaagcagagaggtgtccctctcttagtgcttggtcaagaagtgtggctttattacatgggcggtgtagttggctcctgaagcacaggcgtgcctgctcttgctgtcctcctggagtgctgaggaatgctgtttgaccttggtggtgatattgatcaataatcctccacaagcacagtgcagcgactgccaaatgcttagtcaccaggaagtgtccatcagcccacagcccgtgtctgtgcatgcttagcacctgtcctatctggggaaggagtatcctttattcttcaaatggtgtccttcctactatattgtggttaaatcaggtccttctgactgtgtcgctgttatgacatggtgctgttagtagacagtggcttgtctgcttgcattttttttataacaccctttcttggcaaaagaataaatgggtagcaatcca

SEQ ID NO: 173320 - DNA, 2827 bp, Homo sapiens
  Payload ID: 14069
  Gene Symbol: RAB8A
  Gene Name: RAB8A, member RAS oncogene family
  Uniprot ID: P61006
  ENST ID: ENST00000300935
  CDS Start-End: 274-897
gaagccccgcgactcttcactgctggtcaatcagagcccgtgctctccctagtgccggccaatgggaggtgcgctcgggctgcttccggctccgcgctccgctcgccccctcccaaggtctccccgcgactggcgggacgcaggggcgggcgtcggccgcggtgacgcgcagcgggcctggagccaataaggggcgggctcggtgctgatggacggtgctggtggccagtggagaggcgctggccgcacttcccgtcggggagagagtgtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatgcatttttcactctcgccagagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcgagcatcaaggggacgctgtgtgtgctgcaagtgaccccgaaaacaaccacagccgtcacatggtcctcctgaagttggggcaccctcctctcagcaccaaaatggcccccactccttcgtgtcctcccgctatctccaaatcggacgttctttctagctgagatttttatttttccacatctgtagtgccatgaagcgattctgtctttgacttccaatggcaaacctgggtgatcgggaacaagcacgttgtacccttggctggacatggccaagacacaaggcattccacggcggcaagctgaccgcacagcagtctggcttgattttcagccgtcatcattgggttctgttttgacagctctgctgtcccatagggactgcgactgggaccaggtcaaccacgccaggggggtgtcaccagccttttctttttttctttctttttttttttttcctccttaagctgctgtcaatccaaaccattggcatcatcgtttcttttgaattaaaaccaacatatcagcaatagtctgctctccccgggaatctctaacatgctctgtttacatcgataaatgcacttaaggaaaacaaacaaattaaagctcatcttaaagtccaaggatttttatgtccacattttccctgtaggccacacggacatggccaggtgctgggggtgggtctggacaagatggtagagcccatggattaccccatcgagcggccacctcagaggagatgccacccatcatcaaaagactaaattgggaaaagaagcctcctggcttggtgcagtggctcacacctgtaatcccagcactctgggaggccaaggcgggctgatcacttgagctcaggtgttcgagaccagcctggccaacatggtgagcctgcgtcacctggcttctggcacacagctcggccactgtgtccctcctgcctccctggcaggtccttctaggggccctctcctggctggctttccagggcattccttccactctatccagggtccttcccaagaccacacccaggtccagtcattccctaggacttggcagagagctgtactcacagccaagatcacagcaaaatcagcaaagggaaaaggcatgcagagtgaagtccagaggcaaccagacagaagcatccagaatcctctcacagtggggtcacacaccccatgcttaactcccccaacaatgagttgtaacaaca

SEQ ID NO: 173321 - DNA, 1315 bp, Homo sapiens
  Payload ID: 14069
  Gene Symbol: RAB8A
  Gene Name: RAB8A, member RAS oncogene family
  Uniprot ID: P61006
  ENST ID: ENST00000586682
  CDS Start-End: 6-629
gtaatatggcgaagacctacgattacctgttcaagctgctgctgatcggggactcgggggtggggaagacctgtgtcctgttccgcttctccgaggacgccttcaactccacttttatctccaccataggaattgactttaaaattaggaccatagagctcgatggcaagagaattaaactgcagatatgggacacagccggtcaggaacggtttcggacgatcacaacggcctactacaggggtgcaatgggcatcatgctggtctacgacatcaccaacgagaagtccttcgacaacatccggaactggattcgcaacattgaggagcacgcctctgcagacgtcgaaaagatgatactcgggaacaagtgtgatgtgaatgacaagagacaagtttccaaggaacggggagaaaagctggccctcgactatggaatcaagttcatggagaccagcgcgaaggccaacatcaatgtggaaaatagatatcaaagcaaaaatggacaaaaaattggaaggcaacagcccccaggggagcaaccagggagtcaaaatcacaccggaccagcagaagaggagcagctttttccgatgtgttcttctgtgaggaacaccgccttactctgagcctcgctcagcccagctgactgtgcctgttctgagtgagcccctcactcagccggggccctcccacctccaacgccccgcccacgccgcggccaccgggcccacggccaccagaatgcaattgagaaatcgtttattttagtaactgtctgatctttttcaactttggagatggaataagttaaaaatttgctatttttcctgtaacatctgctgaacgggcccacccacacgttgtatattcagagagagagagggagtcaaggtgtgaccgtcgaccacagccagtgtcaggcctctgcctctgggcctttgctttgtggcctcactgcaacacaaagctccaccaggaggctggttcacgtcccctaccacggaagcgaggtcccagaaggccagcggtggttccaggagcaacagctcccaaaccctgagcaaggcaaccgatcgccaggaccaggaagcatcacccaggagatttggcgcccacttccacctcttctctcagttttggacaagtgacaaaccattttgccccctcactcttcttttttaactgttaaaccaaaggaaagcacaaatgaaggaaatcctgtgtaaagcattgagaaggaaagaagcctggagcagcctctcctgtccacagccaggggttaggtctgcaggcccgtctgcggtccccatcg

SEQ ID NO: 173322 - DNA, 4943 bp, Homo sapiens
  Payload ID: 14070
  Gene Symbol: RAB8B
  Gene Name: RAB8B, member RAS oncogene family
  Uniprot ID: Q92930
  ENST ID: ENST00000321437
  CDS Start-End: 157-780
gggcggggcgcgcaggccttctccgagaggaggggcggggcgtggggcggggcgagcagcggcggattggcgggcacgccccctcgcccgcggccccctccccgcctctctccaccgcctcctctggctccccggtcagagggccggagcgagaagatggcgaagacgtacgattatctcttcaagctcctgctgatcggcgactcgggggtaggcaagacctgcctcctgttccgcttctcagaggacgccttcaacaccaccttcatctccaccatcggaattgattttaaaattagaacgatagaactagatggaaagaaaattaagcttcagatatgggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagcacaggtcacccagcctcagaatcacacctcccggctgctgctgagagcaccactgaacttagacctctcaacacagtatgccaagtggattccagcctcatggcctagcaaaagaacagactccctttttcaaacatggaagcaatgaagtggagacacatgcaggacctaactcgttttttccttgttttattacctgttgcagaagcggttatctttcttttttactttgcacatcagtgttagcctttccctatttcagcacaatcttagactcatatttgcacacttttgtgtcgtgaagttctagacaaatttgtacatgtggcaatgttaaaagagcatttacagcagaggttaatatactaaaattaaagggtatttggtctggttcatatggtcaaatattactgccttggtagcatttatttaagggctttttcttaaataagaatcattaaagtcattaaaaaaatttactgaaatgcccatcttgtcatcaaaggccacaatttctttatttcttcagattaagagctttgcctcatccccgacctgttttccagagtctgggtagctgaatgaatcactttaaaatgattacctctgcctaatctatagaaactgcatttggaaatcaccataatctcatttttccctggggtttgtatttgctattctttcccatgtttgacttaagtgtaatcactcttaagtaatatttgaacattattatctgtttctatttgtgaacttcttgagctgaaattttacgtgggctgagagatataccatttagggttttagtgcagcatctaactgtgattctgtcaataaggatatgtaatatattttttcttaggttcactccttagctggctggtttagttgtaataccaaattcctaccataatccctgtctacaaaagttaggtttagattttagtttgcggaaaccttccctatatagagacagattaacttgttgatataaatttaatagagctagctcttggtaatggtgaaaataatgagttttggttggttttatttggcagatgtttttagaaataaaagtacttagacctagtgcagcctctaggaaaagtcttgccttttcattagagaaaacaggaccaaggtttcagttttcaaacagctgttgttgattgtgtagaacccagttccatctgttttggttcattgttacagaacttagtccagtcatttgggctaaagccaaccaaaagcttagttgcctttctcaacaaacactggtactggtatacttttgtagatgaaaccatcacaaggtatttagtgttaacttgtgtgccaaattcagatcactatgtcgttgttgctctagccttcagtgtcataacacaggggggataaaacagaggggatgagggaaatgaattctgttaataattattcttcctggtatgcctgttttgcttcacaaaggctactatcatgctggatagataagaacaggagatggcagtggaaagggattgcttgttaccacagagaattctcttcaaattaagatatgtcattagaatgcttggaccagtcaatcttttgtacttatttgaaaatataggaacaatttagcagctgcaaatatgcccaagctatttttaatagatatactaaacttattgttgacaaatttcagcctccttaatttttttttttttggtaattacctataggcttaaaagtcattcgttgctgttctagtataattagtagttccgtgattgaaagtttattgtaattctactatcttcaaattagatacattttcaaaaggaaaagataattttttagaaacatcttaatattcactatttcctgaaaaaatccaagcagttaacgctttctggatggtaacaaagtaccttctaaaagataagtgctatgacaccatgtatgaatgtaattctcttagtaatttacctctgactatttggtgtcttaacgctttggtttatataatctcaggggttgtctgcaaaccaaaactgacatattctgtggttagcttttattacttttttttttaacagaatgctttgctttggttatatttcttctttcttcttttgtcttatatggattaataactagtctccatgaacttcacttgaaagagcctgtaaaagttagatgagtctaaaagtgctctttgaagtagcagcaaattgggagtatatgctctgttatatagaaataaattgtccttgctattttcttacatttagctttgctagattgtatatacattgagctaagaccttaggaaattcactttctgcatgataaaatgacccaataaatattccactttgcttaataatgtacatacagtgcattattttttctatttgtagatgaatttaatgacagataattgtctgttccccgctgaaactgaagaaatctagtttttttgtgaacatttttgtggtcttatggataaggtacatgaagatttttgcagcagtattagtggttcagtggctgcactttattaatcagtgtgttaatttttgacagtgattggactagaccttttcaaatagagtctgagggtatcagacagtgaaaatgtgctgtaactaagtagcatgtaaatcagttgattgtaaaacgtttcgctgggaacttattttagctatattttacttcagacagattatgatacaataatctacctgtgcatcagttagtaggtgctgcagggtttcttactatttacagaaacattttgtgcagtctttgttataaattttcagaagactatactctttactttgaaggtctattttttaattatacctcatttagctaactagtattctaatacctggtagaaaaacagtgagccagcctttaagcatctaacaaaatttagactctttgttttgttttgaactgaagacatcattgggaaaggtaggaaatattagtttaggatagagcatacatgtcatatccagtagcataaaaaaagtattatctccctgtctccattaataaatttagctgtgcaatataggtgcgtttttgcagaagtttctagtaagagattataactccattttacaggttctgaatgctcagagtctatattaaggcttataaagtttttcctgtgatcagtaagtgacacatttaagcagacattcttttcaagttcatgacttagattcctttacaaatttagttctcaatctttaaaaaccacatttcattatgttggttaattattataaattttaagcactcatttctgcaatcaggtttctcagaattttttttttttaaacagaagagacattcctttttccttgttacatccaaggggggcacaggggtgggtggaaaggaatgtctaaaaatgaaatcccttgatatagagggacctagacggacaggatatgctaaaataatttcaaattctagcacaattttagagtagaataagtcatttttttagactaataaaattaatggctgtcatgttcactctgaaaaaaatctaaatgactgaaatgtacagaaataaaaattagcaaacaattattctagggatattttcagattttacttcatttcttgaaatgcgtgtgccatatgcaattgcatttcttgtgccaagaaactaatagaacttatttcactttacctttttttaaaatgtgaatttagttattatagttcaattttatggccttacagatggcttttattttgtttgcagctgacactgcagttcctttcatgcaaaataccataaactgtttgatgaaaatcatgcccctaatggaaactctctagtttttccatataactatcctactgtacatgtttaaacatattttatttttgctccaatggcttaatgtgaaaagctcctgcagataagtggacctgtcatgtggttaatcttgtttaagccaattcattaactgtgtactgatactgatgctatgttttttttaaatggattttattccaggtgaactttttttttataataatgttcgtctaaaataaaaactacataatgaaaatgaaaatgctaa

SEQ ID NO: 173323 - DNA, 755 bp, Homo sapiens
  Payload ID: 14070
  Gene Symbol: RAB8B
  Gene Name: RAB8B, member RAS oncogene family
  ENST ID: ENST00000559927
  CDS Start-End: 23-169
gtcagagggccggagcgagaagatggcgaagacgtacgattatctcttcaagctcctgctgatcggcgactcgggggtaggcaagacctgcctcctgttccgcttctcagaggacgccttcaacaccaccttcatctccaccatcgtgcggcctcacatagaggaataaaaacaacccattttattatcccacaaaatgtctgctaatgaagcagtgtgatgtagtggacagagtattggatttggaatcactgtcacttatagcactgtggtgttgggaattgattttaaaattagaacgatagaactagatggaaagaaaattaagcttcagatatgggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtt

SEQ ID NO: 173324 - DNA, 643 bp, Homo sapiens
  Payload ID: 14070
  Gene Symbol: RAB8B
  Gene Name: RAB8B, member RAS oncogene family
  ENST ID: ENST00000558990
  CDS Start-End: 66-209
ggccccctccccgcctctctccaccgcctcctctggctccccggtcagagggccggagcgagaagatggcgaagacgtacgattatctcttcaagctcctgctgatcggcgactcgggggtaggcaagacctgcctcctgttccgcttctcagaggacgccttcaacaccaccttcatctccaccatcgagcaacttccagtcctgtaagcgcctttcatgtgcggcctcacatagaggaataaaaacaacccattttattatcccacaaaatgtctgctaatgaagcagtgtgatgtagtggacagagtattggatttggaatcactgtcacttatagcactgtggtgttgggaattgattttaaaattagaacgatagaactagatggaaagaaaattaagcttcagatatgggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaag

SEQ ID NO: 173325 - DNA, 774 bp, Homo sapiens
  Payload ID: 14070
  Gene Symbol: RAB8B
  Gene Name: RAB8B, member RAS oncogene family
  ENST ID: ENST00000558119
  CDS Start-End: 32-310
ggctccccggtcagagggccggagcgagaagatggcgaagacgtacgattatctcttcaagctcctgctgatcggcgactcgggggtaggcaagacctgcctcctgttccgcttctcagaggacgccttcaacaccaccttcatctccaccatcggaattgattttaaaattagaacgatagaactagatggaaagaaaattaagcttcagatatgggacacagcgggtcaggaaagattccgaacaatcacgacagcgtactacagaggagccatggaaggaattttagggataaaaagaacatcataacagggatgatttggaatagtttacagggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatgaatgacagcaattcagcaggagcaggtggaccagtgaaaataacagaaaaccgatcaaagaagaccagtttctttcgttgctcgctactttgatgaactctttctgagagactgcagcacacctagagggccctttcctgcttctctgaaagc

SEQ ID NO: 173326 - DNA, 584 bp, Homo sapiens
  Payload ID: 14070
  Gene Symbol: RAB8B
  Gene Name: RAB8B, member RAS oncogene family
  ENST ID: ENST00000559006
  CDS Start-End: 20-584
agagggccggagcgagaagatggcgaagacgtacgattatctcttcaagctcctgctgatcggcgactcgggggtaggcaagacctgcctcctgttccgcttctcagaggacgccttcaacaccaccttcatctccaccatcggaattgattttaaaattagaacgatagaactagatggaaagaaaattaagcttcagatatgggacacagcgggtcaggaaagattccgaacaatcacgacagcgtactacagaggagccatgggcattatgctggtctatgacatcacaaatgaaaaatcctttgacaatattaaaaattggatcagaaacattgaagagcatgcctcttccgatgtcgaaagaatgatcctgggtaacaaatgtgatatgaatgacaaaagacaagtgtcaaaagaaagaggggagaagctagcaattgactatgggattaaattcttggagacaagcgcaaaatccagtgcaaatgtagaagaggcattttttacacttgcacgagatataatgacaaaactcaacagaaaaatggtttgtatcacttataatttttatttccattatg

SEQ ID NO: 173327 - DNA, 1313 bp, Homo sapiens
  Payload ID: 14071
  Gene Symbol: RABEPK
  Gene Name: Rab9 effector protein with kelch motifs
  Uniprot ID: Q7Z6M1
  ENST ID: ENST00000259460
  CDS Start-End: 170-1135
ggagtcacggctcgcgactggcctaagtcgccgcagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctggaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaatatcttctgcattatatatctgtttttctcctactttggtaggtgaagaaactaatgcaaataattcttatgtgcactaaaccttgctatattgcctctc

SEQ ID NO: 173328 - DNA, 1504 bp, Homo sapiens
  Payload ID: 14071
  Gene Symbol: RABEPK
  Gene Name: Rab9 effector protein with kelch motifs
  Uniprot ID: Q7Z6M1
  ENST ID: ENST00000373538
  CDS Start-End: 311-1429
aggggcgagggtccccggataccgggtctatcacggtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctcca

SEQ ID NO: 173329 - DNA, 2450 bp, Homo sapiens
  Payload ID: 14071
  Gene Symbol: RABEPK
  Gene Name: Rab9 effector protein with kelch motifs
  ENST ID: ENST00000373544
  CDS Start-End: 167-631
gtcacggctcgcgactggcctaagtcgccgcagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgcttttaaatcttggggattttggactgtcttggcaaatcctaagtatcatcttcattcttccttgatgtttaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaagtatggactggtgggcaccttggggctggtcagggccatcccagtttacacattacctaatataggaagcagaagttagaaaaggaaagcctgactaagtgtctcacttctagacttctttgttatatctcttagctgatatctttttcccacagcaaaattggcatttaaaaagggatagtgaggcctggcatggtggctcacacctgtaatcccagagctttggaaggctgaggcaggtggaccgcttaaggtcaggagttcgagaacagcctggccaacataccttttctctactaaaaacacaaaaattatccgggcatgatggtatgcacctgtaatcccagttactcaggaggctgaggcaggagaatcgcttaaacccaggaggaggaagtttcagtgagccaagattgggccactgcactcagcctgggcaacagagcaatactccatctcaaataaataaataaataaataaataaataaataaataaataaaactaaaaaggtaggccgggaacggtggctcacgtctgtgatcccagcactttgtgacgcccaggtgggaggatcacctgaggtcaggagtttgaaaccagcctggccatcatggcaaaaccccatctctactaaaaatacaaaaattggccgggtgcagcggtgggtgcctgtaatcccagctactcgggaggctgaggcaggagaatcacttgaacccgggaggcggaggtggcaatgaaccaagatcgtgccattgcactccagccttggcaacagagcgagactctctcaaaaactaaataaaaaaataaaaaggtataatgatcaagttaaaaagtttaaaccatacaatttataaagtaaaaaagtaaaagaaagaataagaaagacaaaaaacaaacagaagtaaaagattccccttcagcctttcctttccccgcctcaggtacatgcctgggtgattttttttctttttctttttttttttttgagatggagtctcgctctgttgcccaggctggagtgcagttgcccgatctcggctcactgcaacctccgcctcccgggttcaagcgattctcctgcctcggcctcccaactagctgggattaccagcatgcaccaacatgtccatctaattttttgcgtttttagtagagacagggtttcaccatgttggccaggctggtcttgaagcctgacctcaggtaatctgcccacttcagcctcccaaagtgctgggattacaggcttgagccactgcacccggccagatttttgtatttttattgtagagatgcagttttgccatgttgcccaggctggtctcaaactcatgagctcaagcaatctgcctgcctctgcctgcccacctctgccaccacactcagccaaaatttttaccttgcaaagtaaaattgggaaaattaagagatagcacattcccaagccagagtatttgggaaaaaaaaaaaaaaagacacatcacagtgtgacttttctctttccagaaagaatgggctttgtgattcttttaaagcagttttaaaagtttaaataatattggttttgaatatataaaactataaggaacaagaaaaaaaacatatgtatgtgtatatgtgtgtgtgtgtgtacatgtgtatgtactatcaccccaaaattaaattactgttaacatctc

SEQ ID NO: 173330 - DNA, 1466 bp, Homo sapiens
  Payload ID: 14071
  Gene Symbol: RABEPK
  Gene Name: Rab9 effector protein with kelch motifs
  Uniprot ID: Q7Z6M1
  ENST ID: ENST00000394125
  CDS Start-End: 170-1288
ggagtcacggctcgcgactggcctaagtcgccgcagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaatatcttctgcattatatatctgtttttctcctactttggtaggtgaagaaactaatgcaaataattcttatgtgcactaaaccttgctatattgcctctc

SEQ ID NO: 173331 - DNA, 733 bp, Homo sapiens
  Payload ID: 14071
  Gene Symbol: RABEPK
  Gene Name: Rab9 effector protein with kelch motifs
  ENST ID: ENST00000416065
  CDS Start-End: 1-733
gggcgagggtccccggataccgggtctatcacggtctcgggcagggagtctgaatcttttaggggagtgggcccaagccgggtgcaaagaacggggaagggccttccctggctccgtcccggccactttgaccgaatcagcctgttctttcccgaccccgtctcctatcccctagaactgccacgtggggatgagatttgctgggctggtagcggcggctgctgcgggaggtcccgcccacgtgaagccagcctaactgagctctggactttggggacagctgtcagtggcctaggccgcaggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgaaaccaggacgtggaccacgccagaagtgaccagccccccaccatccccaagaacattccacacatcatcggcagccattggaaaccagctatatgtctttgggggcggagagagaggtg

SEQ ID NO: 173332 - DNA, 1537 bp, Homo sapiens
  Payload ID: 14071
  Gene Symbol: RABEPK
  Gene Name: Rab9 effector protein with kelch motifs
  ENST ID: ENST00000628863
  CDS Start-End: 170-634
ggagtcacggctcgcgactggcctaagtcgccgcagaactgccacgtggggatgagatttgctgggctggtagcggcggctgctgcgggaggtcccgcccacgtgaagccagcctaactgagctctggactttggggacagctgtcagtggcctaggccgcaggacaccatgaagcaactgccagtcttggaacctggagacaagcccaggaaagcaacatggtacaccttgactgtccctggagacagcccctgtgctcgagttggccacagctgttcatatttacccccagttggtaatgccaagagagggaaggtcttcattgttgggggagcaaatccaaacagaagcttctcagacgtgcacaccatggatctgggaaaacaccagtgggacttagatacctgcaagggcctcttgccccggtatgaacatgctagcttcattccctcctgcacacctgaccgtatctgggtatttggaggtgccaaccaatcaggaaatcgaaattgtctacaagtcctgaatcctgcttttaaatcttggggattttggactgtcttggcaaatcctaagtatcatcttcattcttccttgatgtttaaaccaggacgtggaccacgccagaagtgaccagccccccaccatccccaagaacattccacacatcatcggcagccattggaaaccagctatatgtctttgggggcggagagagaggtgcccagcccgtgcaggacacgaagctgcatgtgtttgacgcaaacactctgacctggtcacagccagagacacttggaaatcctccatctccccggcatggtcatgtgatggtggcagcagggacaaagctcttcatccacggaggcttggcgggggacagattctatgatgacctccactgcattgatataagtgacatgaaatggcagaagctaaatcccactggggctgctccagcaggctgtgctgcccactcagctgtggccatgggaaaacatgtgtacatctttggtggaatgactcctgcaggagcactggacacaatgtaccagtatcacacagaagagcagcattggaccttgcttaaatttgatactcttctaccccctggacgattggaccattccatgtgtatcattccatggccagtgacgtgtgcttctgagaaagaagattccaactctctcactctgaaccatgaagctgagaaagaggattcagctgacaaagtaatgagccacagtggtgactcacatgaggaaagccagactgctacactgctctgtttggtgtttggtgggatgaatacagaaggggaaatctatgacgattgtattgtgactgtagtggactaataaaacccacatttttattacctgtcagttactttcagaatagttaagtaaaacattagctgttttatacctccaaaatatcttctgcattatatatctgtttttctcctactttggtaggtgaagaaactaatgcaaataattcttatgtgcactaaaccttgctatattgcctctc

SEQ ID NO: 173333 - DNA, 2039 bp, Homo sapiens
  Payload ID: 14072
  Gene Symbol: RAB9A
  Gene Name: RAB9A, member RAS oncogene family
  Uniprot ID: P51151
  ENST ID: ENST00000464506
  CDS Start-End: 280-885
gccatgttgttccctccgcgctggacgggagcagctggagcgggagcctggctgcgctaccgcggctgcctcctgctgtgcaggtccccgaccctctctctgtcctcattgcgcccagacgggccggcccagagctcccgggtcgtctttcgtgtggccgcgagacactcttgcactcctgtaatgagcctggcactgtgatgaaacacttttcccgtgtcgtttgagtgcatcttctcaacaaccctaggagggttcttgaagcttttgagattaacaatggcaggaaaatcatcactttttaaagtaattctccttggagatggtggagttgggaagagttcacttatgaacagatatgtaactaataagtttgatacccagctcttccatacaataggtgtggaatttttaaataaagatttggaagtggatggacattttgttaccatgcagatttgggacacggcaggtcaggagcgattccgaagcctgaggacaccattttacagaggttctgactgctgcctgcttacttttagtgtcgatgattcacaaagcttccagaacttaagtaactggaagaaagaattcatatattatgcagatgtgaaagagcctgagagctttccttttgtgattctgggtaacaagattgacataagcgaacggcaggtgtctacagaagaagcccaagcttggtgcagggacaacggcgactatccttattttgaaacaagtgcaaaagatgccacaaatgtggcagcagcctttgaggaagcggttcgaagagttcttgctaccgaggataggtcagatcatttgattcagacagacacagtcaatcttcaccgaaagcccaagcctagctcatcttgctgttgattgttagattgttgatgcattctaaccaactcacacatatacacaaaatcaacatggggatggagaagagaattagcgtttgcagcagtgtatcatctactaataaaattaaactaatgttgctgcttcattagttggtgggagaagggacacatccactcttggaggaatatatttactcaataatggcaccttacatttataaattgtaacagttgtctaataacgtttctttaatttaaatatgtaagttgcagagctaataaatgaaatgaccaagactttaattataataaaaataagaaacttgactattctagaagttatacttggattttttcctgggaaaatggagaactactttttatatgtgtatgtttttatgcaattagcattgtattcttggttcagggaaatactttcctaaagcaataatgttagatattaaagattaaaatctaatgtatttgcaatgcattgttaatttacttcttcattctcttcaaaatgatttaaccattcctgttttcattctacatactagaattactctcactagtaattactcatcatttgtgtgccattcatgcacccccacccccataaatcatgttccacagtctcaggcggagggtgggcccccagtggtacaagagttgcttcatacagtctgtaatacatccagctaaattcaagttgtctatgaatggaaagcctttccatagatagagttcagttttaagaaaaaggctaactactgaacttggagaacagacaaatgtgcatttgataactgatgtaataattacaatgtactgtgtggaagatacaaaattacaattcgattaatggactaaatatttttgttactttcttgacccttggggaaagtttcttaattgaagttaaaacattcctttataacacaagacacaagctgactttatcactctcagaagaaatactaagaaggattgtactttgtgagagggtaaacgaagacatctttattcggcaatgtatttacttagtgtcttctctattactgaacatttagtgatttgctctcaaggagattttttgttagaaaaagacttgttgcagtgatcagacttgataaagcaaattgtggtcttttgtggatgaagttcata

SEQ ID NO: 173334 - DNA, 1271 bp, Homo sapiens
  Payload ID: 14072
  Gene Symbol: RAB9A
  Gene Name: RAB9A, member RAS oncogene family
  Uniprot ID: P51151
  ENST ID: ENST00000618931
  CDS Start-End: 195-800
cgtcgccatgttgttccctccgcgctggacgggagcagctggagcgggagcctggctgcgctaccgcggctgcctcctgctgtgcaggtccccgaccctctctctgtcctcattgcgcccagacgggccggcccagagctcccgggtcgtctttcgtgtggccgcgagggttcttgaagcttttgagattaacaatggcaggaaaatcatcactttttaaagtaattctccttggagatggtggagttgggaagagttcacttatgaacagatatgtaactaataagtttgatacccagctcttccatacaataggtgtggaatttttaaataaagatttggaagtggatggacattttgttaccatgcagatttgggacacggcaggtcaggagcgattccgaagcctgaggacaccattttacagaggttctgactgctgcctgcttacttttagtgtcgatgattcacaaagcttccagaacttaagtaactggaagaaagaattcatatattatgcagatgtgaaagagcctgagagctttccttttgtgattctgggtaacaagattgacataagcgaacggcaggtgtctacagaagaagcccaagcttggtgcagggacaacggcgactatccttattttgaaacaagtgcaaaagatgccacaaatgtggcagcagcctttgaggaagcggttcgaagagttcttgctaccgaggataggtcagatcatttgattcagacagacacagtcaatcttcaccgaaagcccaagcctagctcatcttgctgttgattgttagattgttgatgcattctaaccaactcacacatatacacaaaatcaacatggggatggagaagagaattagcgtttgcagcagtgtatcatctactaataaaattaaactaatgttgctgcttcattagttggtgggagaagggacacatccactcttggaggaatatatttactcaataatggcaccttacatttataaattgtaacagttgtctaataacgtttctttaatttaaatatgtaagttgcagagctaataaatgaaatgaccaagactttaattataataaaaataagaaacttgactattctagaagttatacttggattttttcctgggaaaatggagaactactttttatatgtgtatgtttttatgcaattagcattgtattcttggttcagggaaatactttcctaaagcaataatgttagatattaaagattaaaatctaatgtatttgc

SEQ ID NO: 173335 - DNA, 3748 bp, Homo sapiens
  Payload ID: 14073
  Gene Symbol: RAB9B
  Gene Name: RAB9B, member RAS oncogene family
  Uniprot ID: Q9NP90
  ENST ID: ENST00000243298
  CDS Start-End: 286-891
cgagcggcagctgtcaggccaccgaggtccaagccgcacttgctgccccattgaggacgaggaggcagcaggagcagtgacggtgactctaaggagccggattcccggcacgcagagctgacctgcctggcacccgcggccctctcctgtttccttcccattgtgttggcaccctaaaaagaaagaataaaacaacaacaggaaaaaaaggaaaatatttaaattgtgacaaaaacccactgggttctcttggttacaaactccttcccttctggtgctgcaaaaatgagtgggaaatccctgctcttaaaggtcattctcttgggtgatggtggagttgggaaaagttcgcttatgaaccgttacgtaaccaacaaatttgactcccaggcttttcacaccataggggtagagttcttaaatcgagatctggaggtagatggacgctttgtaaccctccagatctgggacactgcagggcaggaacgtttcaagagccttaggacacccttctacaggggagcagactgctgcctcttgaccttcagcgtggatgatcggcagagcttcgagaatcttggtaactggcagaaagaatttatttactatgcggatgtgaaggaccctgagcatttcccctttgtagttctgggtaacaaggtagacaaagaggataggcaagtgactactgaggaggcacaaacctggtgcatggagaatggggattacccttatttagaaactagtgccaaagatgatactaatgtgacagtggcctttgaagaagctgtcaggcaggtgctggctgtagaggaacagctggagcattgcatgttgggtcacaccattgacttgaacagtggctccaaagcagggtcttcgtgctgttaaagatagggagccttttaaaaatgtgccccaaattgatcagtcagtagtgtaagaataactgtgcccctctaagagtgcacacacacgcacacaagagggtaagagacaaggttctgattgtgaaacagagcctttcaaattgaagtgtagattgatttaaaaaaattaaaaattaaaaaaaatgaagctctatcaagccaagtgtattttgcgtgatttctgctatttccccttcttgtgtgtctcaggacatatcagaaaattttagtcctgagacagttaaatattttttaaatcacagtttaaacctagaacccagctgcatgaaggagttaaagagctacaactatttcttaaagtgttccattaatcaactaacaaatgtcactatcagactcttgccaagcagtttctgacatttctgccaaaggggaaaaaaatcagactttgagctgtattacaataaaaataataatgcaaataaggattcctaggcttgaattaaagaagttgtaatgattaggagtgcaaaagtataatgatatacactgacttgtttaaatccttatgtatggttcgctcccatctgagcttttcaaaaaatcccatctcaataagagatactctaatgacactggcaattgattatacttcttgtgtttgaagtcataggatactagtgaatggattatgcttaaatatgccaaccacctttgcaaataaatggttggtctgcttttaattcctaagtctacttttgctgcatagagatgttgcttctctgacaacctcttaccaatttagcaatgctgcttagtatatgaatttggatgcagtgctctctgctcatcatttagatggtcctttgatccaacatgctgggctcatggagaaggcttcataaaagattgggggataatgaacttttctcacaaggctccttaactcaaatatttattgcagaagaaggaactggtttcttatatgttgcactgtatgttcaactagcctaattaggacattgaaagtgacagaagagcagatcttaacccagtgttagaatgaatttcccataaacagagttgtccaacagtggaatggactgccttaatagtgagctccctgcctctgaaaatattcactggatgaccatctgttagaataccataaaaagattttctgtgctggctacatgttcaatataaagtcctttctggctctaagttctatgaatatataaactacatcagtgccatgctgtggttagatttatctgatgataacagctaagactatggagagggactttaaaaattctcaaaccattctgtgatcaatctttaacagcaactacatagctcttccttttgcttttgcactgtggcaggaaaaattcttgagctctgagtaatctttatgtgactgataaaaaacatcttaaagctcccatgttaaaatataaaaatggtttgacaatttttgattaccatgactgtcagttatatactatattatgaatatgcagtgtggttcttgttggttgatctgtttaccctgcatagattttaatctgtactttaaaacatctatgataaaaatagtgacagacagaaattaccccaaaaagagacctaggccaggaagggggtgggagctttcataggaatacagcctagaactctccattgtagccacgtatggaatcagccttacttacatgtaggacctttgtgctttaagagctctgggacatattggccaaatagaaaagaagaggacagtatttcaactcagtcatactcaatatttccaattaagatataatcctgacaccattgttcaattaactttgacgccagaagtcaaagccagaactgggaccccacagctcttaagtactggtccctatcctgcctatgcctatagccagccacactggtttccaagttctgtgatcattttgctacaatcatgttagggtgaaaatctgtacgtcagaactgttaaatgctaattatttttaagtgcatgagacctggggccttctctttctacttgcactctgcttatactagtttctatttgtagatctcaggccttcatcataaagacctctatcaactcacaaaagtatttgtctctattagagtggcatgtggtcatttgagtaaaaaaaaaaaaattacatgggtatcggattcataggcatcctgtccatctaagacaagtgttaattttattggcccatcagctggagcccctttcctcttagccataccattgttttctaccaaattaccactcaatatcttaatgaaagcactcaacattaagtgacataaacagtggcatttgggtaagcaacactcagtggggtgctgacatacagtttgggtaagattaaaaaacaccaaaggctgaaatctgtgagtaccaagaactgtgcatataggtttagaaattgactgtgtaccctagaatgtgcagtgtaatattttcaataggtgtttttttaaagaacactagatttttggaataatatatttctaattaggactatactgtttttcaatggtctgttaaaacatcatacagaatatttatttagtttattgtcatgtattggctaactttcaggggcctcagattccatatgtcttcagtggattgatgaatatcaggttaatttgtgcctgccccagccatctctactttattctgaggtattccacaatcctcttgttgcaggtgctgctaaaaaaaactcaaaattgtgtatcaaatattttctttcaactgtaaaaaatcatctgtgttaaagtgaataaaaagtgcattttgaataaccagcacacaa

SEQ ID NO: 173336 - DNA, 2490 bp, Homo sapiens
  Payload ID: 14074
  Gene Symbol: RABEP1
  Gene Name: rabaptin, RAB GTPase binding effector protein 1
  Uniprot ID: Q15276
  ENST ID: ENST00000341923
  CDS Start-End: 1-2490
atggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaagtttgccatctcttggagcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatga

SEQ ID NO: 173337 - DNA, 5365 bp, Homo sapiens
  Payload ID: 14074
  Gene Symbol: RABEP1
  Gene Name: rabaptin, RAB GTPase binding effector protein 1
  Uniprot ID: Q15276
  ENST ID: ENST00000537505
  CDS Start-End: 188-2776
ggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacgtttctcttcagcaacgggtagcagaattggaaaaaattaatgcagaatttttacgtgcacaacagcagcttgaacaagaatttaatcaaaagagagcaaaatttaaggagttatatttggctaaagaggaggatctgaagaggcaaaatgcagtattacaagctgcacaagatgatttgggacaccttcgaacccagctgtgggaagctcaagcagagatggagaatattaaggcgattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggcccaagaggatgctgagaaacttcggtccgttgtgatgccaatggaaaaggaaattgcagctttgaaggataaactgacagaggctgaagacaaaattaaagagctggaggcctcaaaggttaaagaactgaatcattatctggaagctgagaaatcttgtaggactgatctagagatgtatgtagctgttttgaatactcagaaatctgttctacaggaagatgctgagaaactgcggaaagaattgcatgaagtttgccatctcttggagcaagagcgacaacaacacaaccagttaaaacatacgtggcagaaggccaatgaccagtttctggaatctcagcgtttactgatgagagacatgcagcgaatggagattgtgctaacttcagaacagctccgacaagttgaagaactgaagaagaaagatcaggaggatgatgaacaacaaagactcaataagagaaaggatcacaaaaaagcagatgttgaggaagaaataaaaataccagtagtgtgtgctttaactcaagaagaatcttcagcccagttatcaaatgaagaggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtggttatcgtttagttagtgaaacagaatggaatctcttgcagaaagaggtacataatgctggaaataaacttggtagacgttgtgatatgtgttccaattacgaaaaacagttacaaggaattcagattcaggaggctgaaacgagagaccaggtgaaaaaactacagctgatgctaaggcaagctaatgaccagttagagaagacaatgaaagataagcaggagctggaagacttcataaagcaaagcagcgaagattcgagtcaccagatctctgcactcgtcctaagagcccaggcctccgagatcttacttgaagagttacagcaggggctttcccaggcaaagagggatgttcaggaacagatggcggtgctgatgcagtcacgggaacaggtttcagaagagctggtgaggttacagaaagataatgacagtctccagggaaagcacagcctgcatgtgtcattacagcaagcagaagacttcatcctcccagacactacagaggcactgcgggagttggtattaaaataccgtgaggacatcattaatgtgcggacagcagcagaccacgtagaagaaaagctgaaggctgagatacttttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgcagttagagcggatccggcaagctgactccttggagagaatccgggcaattctgaatgatactaaactgacagacattaaccagcttcctgagacatgacaccctcatggcaggattctagcctgcactttgggtttttaactcatctttagagcaacagtaattattatttaactcttaactgaagaaagagaagtcacaacaaaaggaagactggagaaatgcttacttctagagggagaagactgtgcggcacaggaaacagcaaacagtggggtgatctgcagcccagagaccttcaaatgcgaacactataaactccaggcttgattccaacaggcgtgggatcagatttggtgatggaaaaagcgctgtttccttgcctgctttctccaagacagattttcggaacacatttccctaccctaaagcgacatcccagtagtgtttggaattttctgttcatagatattggaagagagaatttgctttatctgttgtctagagctcatcagtaacagtattcagttagcagacagaagtgtagtatgctgtatgaatattttatattaaaatatgaaggtttgagagcaggccattggctactgactgtattttgttttccttttaccattttatcttatcttgctttggaggaccttaaatgctactgaaacttacctgagaaccataggactgtggcaaacaaaaccaattcatgaagtgaattaatgatgaggatctgaaaacttggctggggctatatatactggaagttgaaggttaaaggaaaagcacaagaaactttggaagcactttttctgcatacttagatgatcttcatgggcccacagggtaccaggataaagccgaactggtaccatctactcttttgaagtgttttagtctagttattggatcagtgaaaaacattagtatacgtttttaaataggctaatttttcaacttggatcattaggcttacgtactacttgtttcaaatgtgtcaaatacaaaaatggtaactaggttgacagatactttgtatttttcttttgaattcagacctggaatgtaagtaagtgacaatgcttatggaaagccagttagttagaattggaaatctgtcttgtcattttacaagcattagattcctttcctgtgtgaagaaagcctcagtgaaacaggtctttgccataactttatgaagtgctacagaaagcacaaagaattgattcatgttcatcaatacctgctgagagtactgtcccaggaatatccagtggatggattcatcatccaggaggttcaaaagtaagatggttttcaaatcatttttgagactggttgcataacagcagggtacctgaaagagccttctgggagttagtgaactaggtagattgttttgttcacataacgccaccatcaacttaaagtgaattgtctttgttataaatgaggtcactatggacttaccctaaagatcttctgtacttctgtcttccataggacaaatgataagtactacatacctcatctcttgggttattattgtagtcttgcattcatggttatgaatttaaaaataaataccaattatggaaatagtactaaaggcttgccgcacatgaaacattattttaattggtttaaagtccctttataaagagtgctacatggtttagataaaggaaacatataactattgagttacaggggattttattaattataaaatgcaatcaatttaaattacgtaggtttaagactagtcccttggataagccccaagcgaatttgtcttcagattattaaaattagtgctgtaaatcagggtgggcaattcacagcctttctgaactgactgaactagagcttgcagtgaagtgttctgctgagactgagcaccttacagatatttttctccagaagatggtgctgggtaataaaatcatcacaattagggaatggttagtggtctctactgtggcaaatgccaactgttggaattcactttattgtagaaaaacccaaactgagactcttaagttttgtttagcaatgtgtttctggtatgaaacaaactactgtgtcactgtccaggtaggaaacaattctttcaactgggttttcagcataaatgggaactgatgtagaaggcaggatttagcccttctaggcaaaagaaaagctcagttgggtttcacgagtgttcctgtgcttatattcagtctgtgcctacatgttctcatgcatgtctaacctgatttacctcttacctgtaacctaccttatcatgtggcttttaattgacagtcactcagccatttctaagcagatatagtagtacctttcagaactcacattggcaagtgtaaaaagatgacttaaggtgaagtgaggacaaaatcacattctgcatactaacctatttttttctccctttaaggtgctaaacttgcacctcatgtccactcagtaacaagtattgggacgtagagcacagcctcactcagctctgaaaggtaatacagcttgtgaggaagtgagccagcagtggcctttgcaattgtggatcttgagctctgctctcagcagatttcaggtgtaaccatttgttaactgtactgaaggtgtgtcctcaagaagaaagtgttcaaattaaaaaagctgctgccaagtaca

SEQ ID NO: 173338 - DNA, 551 bp, Homo sapiens
  Payload ID: 14074
  Gene Symbol: RABEP1
  Gene Name: rabaptin, RAB GTPase binding effector protein 1
  ENST ID: ENST00000575991
  CDS Start-End: 223-551
gcactgcttatttcccgctgtcaggatgaggaggcggaggtcggcggtcgggtccgtctctgcccgcggctgtggcggcgccggcggatccagccttagcggtttctctctgggcggcggcggcggcggctcggttgacgcctcctccgccagctgagcccgcgggagcccaggacgccgcttccccgcccatccccgctccccgaggccggccgcctggtcatggcgcagccgggcccggcttcccagcctgacggagaagggaagggaagcatttttggtgggctgtcagagagaggaaactgggatgtcttcaggctgcattttaatgatcaccttttgcatttggtgtcaggcaagaaaactttgttcttccacaatcccactttgttactgcacacagaggcaagatacagagagcttgtggttctgaacaggagtgtttctcttcagcaacgggtagcagaattggaaaaaattaatgcagaatttttacgtgcacaacagcagcttgaacaagaatttaatcaaaagagagcaaaatttaagga

SEQ ID NO: 173339 - DNA, 578 bp, Homo sapiens
  Payload ID: 14074
  Gene Symbol: RABEP1
  Gene Name: rabaptin, RAB GTPase binding effector protein 1
  ENST ID: ENST00000574568
  CDS Start-End: 1-578
aaaaaagcagatgttgaggaagaaataaaaataccagtagtgtgtgctttaactcaagaagaatcttcagcccagttatcaaatgaagagaaaacaccattcaaaataaaaataactgatagatcatcctacccagaggtaacaactaatattttggagcatttagacagcacccgtggctcagttcattccttagatgcaggcttgctgttgccatctggagatcctttcagtaaatcggacaatgacatgtttaaagatggactcaggagagcacagtctacagacagcttgggaacctcgggctcattgcaatccaaagctttaggctataactacaaagcaaaatctgctggaaacctggacgagtcagattttggaccactggtaggagcagattcagtgtctgagaactttgatactgcatcccttgggtcactccagatgccaagtgggtttatgttaaccaaagatcaggaaagagcaatcaaggcgatgacaccagaacaagaagagacagcgtccctcctctccagcgttacccagggcatggagagtgcctatgtgtcccctagtgg

SEQ ID NO: 173340 - DNA, 583 bp, Homo sapiens
  Payload ID: 14074
  Gene Symbol: RABEP1
  Gene Name: rabaptin, RAB GTPase binding effector protein 1
  ENST ID: ENST00000572250
  CDS Start-End: 1-460
tttcctaaaagagcagatccaagcagaacagtgtttaaaagaaaatcttgaagaaactctgcaactagaaatagaaaactgcaaggaggaaatagcttctatttctagcctaaaagctgaattagaaagaataaaagtggaaaaaggacagttggagtccacattaagagagaagtctcaacagcttgagagtcttcaggaaataaagatcagtttggaagagcagttaaagaaagagactgctgctaaggctaccgttgaacaactaatgtttgaagagaagaataaagctcagagattacagacagaattagatgtcagtgagcaagtccagagggattttgtaaagctttcacagacccttcaggtgaggcatttggggaaccacatacagagcacgaaggcagttttgggggacagaaccttgccgatccctgacttgaccactggcagtagctagaggtttagagactggctgctcctacctccaccccaaatgtctgactcatcattcaagccagaaacctggtgtgttcttcacacttggcccatttttctttttctgtatgccttgccaattttg

SEQ ID NO: 173341 - DNA, 461 bp, Homo sapiens
  Payload ID: 14074
  Gene Symbol: RABEP1
  Gene Name: rabaptin, RAB GTPase binding effector protein 1
  ENST ID: ENST00000570487
  CDS Start-End: 1-304
gattgccacagtctctgagaacaccaagcaagaagctatagatgaagtgaaaagacagtggagagaagaagttgcttcacttcaggctgttatgaaagaaacagttcgtgactatgagcaccagttccaccttaggctggagcaggagcgaacacagtgggcacagtatagagaatccgcagagagggaaatagctgatttaagaagaaggctgtctgaaggtcaagaggaggaaaatttagaaaatgaaatgaaaaaggatcccatccaggataccatattgcatttagttgtgtctccttagatgcctcttggctgtgacagtttctcagatttttcttgtttttaatgacctttctgtcattttttaaagtgctttttaaaggttttgtttatgatgacattcagcacttggaattgtgaagtcatatttatattaataaataacttgatttgtgatc

SEQ ID NO: 173342 - DNA, 2175 bp, Homo sapiens
  Payload ID: 14075
  Gene Symbol: RABEP2
  Gene Name: rabaptin, RAB GTPase binding effector protein 2
  Uniprot ID: Q9H5N1
  ENST ID: ENST00000357573
  CDS Start-End: 52-1653
ggtgcgctccgtcaccagggagtgcgggaatccgccgtttgcgctgaggcaatggcggcagctgcgccggtggccgcggacgacgatgagcggcggcggcggccgggggctgcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgca

SEQ ID NO: 173343 - DNA, 2821 bp, Homo sapiens
  Payload ID: 14075
  Gene Symbol: RABEP2
  Gene Name: rabaptin, RAB GTPase binding effector protein 2
  Uniprot ID: Q9H5N1
  ENST ID: ENST00000358201
  CDS Start-End: 590-2299
aacaaaatgggggtggggacgtgcaagtttcagactccgactaactacgcggggactccgaggcgctcagaaaaatgaagccgacccggccctgccccgagggacgctccaagagggcggaggtgcagggagggccccgccacaattcgcggtaacgcaagccaggctcgggcggaagggcggccggagccgatcaaaggctggctccgggcaggggcagcgagggagcgagggggagctctccgcaggccggtgtcccggaggaggcataattggagcagggcttccaaggtcacggagagacgccgggcaagacctcttaaggatcctcttccgggcttgaaaggcaggcgtcctcccgaaccgcgcgacccagccaagaagagccggggcggggccggggccggggccgggggccgactcgggaatcttcggccgaggctcggcaatccccccatcctccgtccggggcctccagcccggggccgatccggaaacagccgagcggatccggaaacagccgagaggacccggaagcggtgcgctccgtcaccagggagtgcgggaatccgccgtttgcgctgaggcaatggcggcagctgcgccggtggccgcggacgacgatgagcggcggcggcggccgggggctgcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggttgaggggactgacgggggccaccaccgccccgccctccagcgcctcctcccagggtggctgggcctcctgttctcagggatcacacctgggtgaggggcccaagcccctcccggaaccaaaggtgcaggctcaggcctgcggctttctggctgctgtgctgcctcctgggctccagccctcccctgcccccagcccgtcccctgcccagggcacagcggagccatgggggctgggagtccccatcagaggcagtgaggtgggccccggccctgggacaggcagctgccttctggtctgcatgacactaagacgcttgtccacagcggcgacccaggcctccaagcttgcacagaggcaaggccagacttttccgtcgtttattttcaataaataagcagctcagcgca

SEQ ID NO: 173344 - DNA, 1645 bp, Homo sapiens
  Payload ID: 14075
  Gene Symbol: RABEP2
  Gene Name: rabaptin, RAB GTPase binding effector protein 2
  ENST ID: ENST00000544477
  CDS Start-End: 34-1530
ggagtgcgggaatccgccgtttgcgctgaggcaatggcggcagctgcgccggtggccgcggacgacgatgagcggcggcggcggccgggggctgactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagagggccgacagctgcagaaggacctggagagcgtcagtcgcgagcgggacgagctccaagagggcctgagacggagcaatgaggactgtgccaagcagatgcaggtgctcctggcccaggtccagaactcagagcagctgctgcggaccctgcaagggaccgtgagccaggcccaggagcgggtgcagctgcagatggcggagctggtcaccacccacaagtgcctgcaccatgaggtaaagcggttgaatgaggaaaaccaagggctccgggccgagcagctgccatcctcagccccccagggctcgcagcaggagcagggcgaggaggaatcactgcccagctctgtgccagagctgcagcagctgctgtgctgcacgcggcaagaggcgagggcccggctgcaggcccaggagcacggggccgagcgcctgcggatcgagatcgtgacgctgcgggaggctctggaggaggagacagtggccagggccagcctggaggggcagctgagggtgcagcgggaggagacagaggtgctggaggcctccctgtgcagcctgaggacagagatggagcgggtgcagcaggaacagagcaaggcccagctcccagacctcctctcagaacagagggccaaggtgctgcggctgcaggcagagctggagaccagtgagcaggtgcagagggatttcgtgcgactgtcccaggccctgcaggtgcgcctagagcggatccgccaggctgagaccctggagcaagtgcgcagcatcatggatgaggcgccactcacggacgtcagggacatcaaggacacctgaggggtcaggatatccccacccccaccctgggaaagacgcctttccccactcctgaaccatgaggcctcgctctggggtcttggatggcttttccaccgtccctgagactggggtt

SEQ ID NO: 173345 - DNA, 589 bp, Homo sapiens
  Payload ID: 14075
  Gene Symbol: RABEP2
  Gene Name: rabaptin, RAB GTPase binding effector protein 2
  ENST ID: ENST00000563577
  CDS Start-End: 166-309
acttgctaagccggtaggtggcctggggtaagagatgggaagagaggctgatccctgtcccccacagcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagagcccagctcagagtctgatccagcgtaaatatttattactacgattaagggccgggtgtggtggctcatgcctgtaatcccagcactttgggaggctgagacgggaggattgcttgagctcaggagttcaagaccagcctgggcaacatgactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaag

SEQ ID NO: 173346 - DNA, 1045 bp, Homo sapiens
  Payload ID: 14075
  Gene Symbol: RABEP2
  Gene Name: rabaptin, RAB GTPase binding effector protein 2
  ENST ID: ENST00000568703
  CDS Start-End: 311-1045
gaaactggccaccgcgaagagatggagtgtaggcagcacccggcagagcgagtgggaagggggcggggcaggggcggggccaggtgagccgggcgggcccaggtgaaggaggccccagatgaaggcaacagtactaggttgcaggacttgctaagccggtaggtggcctggggtaagagatgggaagagaggctgatccctgtcccccacagcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactcagtgggagcagctgcagacagag

SEQ ID NO: 173347 - DNA, 545 bp, Homo sapiens
  Payload ID: 14075
  Gene Symbol: RABEP2
  Gene Name: rabaptin, RAB GTPase binding effector protein 2
  ENST ID: ENST00000566762
  CDS Start-End: 413-545
gtcactttgaagaatctggcgggagaagaggaagtgcacggtgagggccgacttggaatggaatggcggacccactcaagattctgtccaggccttcagaagttaaacgtgatcacttgtgctgggacagccaatagaggagtctgagatgatcatttccaaggagttcttcacagaggaggtagctttggagctgggctttgaggttgggcagtatttgaaacagtagagacggagcaaagaacccctgggcagaggaaacaactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggc

SEQ ID NO: 173348 - DNA, 841 bp, Homo sapiens
  Payload ID: 14075
  Gene Symbol: RABEP2
  Gene Name: rabaptin, RAB GTPase binding effector protein 2
  ENST ID: ENST00000567483
  CDS Start-End: 1-841
ccggccattgaaggggtagggccagtgacagcactggaggactcccggtcccaggaaggggcaaatggtgaggccgagtcaggtgagctcagccggcttcgggctgagctggcaggcgccctggcagaaatggaaaccatgaaggctgtggcagaggtgagcgagagcacgaaggccgaggctgtggctgcggtgcagcggcagtgccaagaggaggtggcctcgctgcaggccatcctgaaagactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctgagcggagatgggggtccagccgctgaggccttcgctcacaactgcgatgacagcgcctccatctcctccttctcccttggcggtggggtcggcagcagctcctccctgccccaaagccgccagggcctgagccctgaacaggaagagacggcctcgctggtgtctacgggcaccctggttcccgagggcatctacctgccccctcctggctaccagctcgtcccagacactc

SEQ ID NO: 173349 - DNA, 538 bp, Homo sapiens
  Payload ID: 14075
  Gene Symbol: RABEP2
  Gene Name: rabaptin, RAB GTPase binding effector protein 2
  ENST ID: ENST00000561501
  CDS Start-End: 322-538
atagctaagtttagctcccagcttctatctgttgccttgtcccatgtcatttcttgtccctcactgatgattgatcaaccctgaagatgggcgagaaacttctcagttccccaaaccaacctcattttagtctggacttctgggaaatagaatcagccctggcccagtctctactccatcagcagctatgaagcccagatcaccgccctgaagcaggagcgacagcagcagcagcaggactgtgaggagaaggagcgggagctgggccgcctgaagcagctgctgtcccgggcctaccccctggactccctggagaagcagatggaaaaggcccacgaggactcggagaagctgcgggagatcgtactgcccatggaaaaggagatcgaggagctgaaggcgaagctgctgagggccgaggagctgattcaggagatccagagacgtccccggcatgccccttccctgcacggctccacggagttgctgcccctgtcccgggatccatcgcccccgctggagcctctggaggagctga

SEQ ID NO: 173350 - DNA, 6678 bp, Homo sapiens
  Payload ID: 14076
  Gene Symbol: RBSN
  Gene Name: rabenosyn, RAB effector
  Uniprot ID: Q9H1K0
  ENST ID: ENST00000253699
  CDS Start-End: 615-2969
gagttccgagcgaccgatggagatggcggctgcggctgagtgacggacggtggaggcccagagcccgggcctgaagggggggacaaacctgggtgcccgcaggagcccggcagggtactgtgctaaaccctggggagacggcgaagtggaaaacatatagagtctgtgccctcccagattttacagtcttacttggtcacttcacgtatgtacctgcggttataaattgagatgagtgctgtgaaggagaagtccattctgatgctctgagtgtcttacaagtatcaagaacttactatatgtggttgaataaacaatcaaggtaaagagcatcaagtaaaaacttctgcttgttgataagtacttcagacattcccccagtggctgaagtggcatatgaattatgaagttggatcatttggaatgaatgtaagagaattgccaagggctcctcctactccagagaggaaacctcatccagggccatgaagccacttcctcaccatctgtgtgctgcttaagctaatgctgcgggaaccatggttccttgggaggaatcaagctgactcttggcatgagattcctgccttcctagggttgagagcggcactgccatggcttctctggacgacccaggggaagtgagggagggcttcctctgccctctgtgcctgaaggatctgcagtctttctatcagcttcactcacattacgaggaagaacactcaggggaagaccgtgatgtcaaagggcaaattaaaagtcttgtccagaaggctaaaaaagcaaaggacaggttgttgaaacgagaaggggatgatcgagcagagtcagggacccaaggatatgagtctttcagctatggaggggttgatccttacatgtgggaaccccaggagcttggtgctgtgagaagccatctttccgacttcaaaaaacaccgagctgctagaattgaccactatgttgtggaagtcaataaactaataatcaggttagagaagctcactgcatttgacagaacaaatactgagtctgcaaagattcgagcaatagaaaagtctgtggtgccttgggtcaacgaccaggatgtccctttctgtccagactgtgggaataagttcagcatccggaaccgccgccaccactgccgcctctgcgggtctattatgtgcaagaagtgtatggagctcatcagccttcccttggcaaacaagctcaccagtgccagcaaggagtccctgagcacccacaccagccccagccagtcacccaacagtgtccatggctcccgccgaggcagcatcagcagcatgagcagtgtcagctcggtcctggatgagaaggacgatgaccggatccgctgctgtacacactgcaaggacacgctgctcaagagagagcagcagattgatgagaaggagcacacacctgacatcgtgaagctctacgagaaattacgactttgcatggagaaagttgaccagaaagctccagaatacatcaggatggcagcatcattaaatgctggggagacaacctacagtctggaacatgccagtgaccttcgagtggaagtgcagaaagtgtatgagctgatagacgctttaagtaagaagatcttaaccttgggcttgaaccaggaccctccaccacatccaagcaatttgcggctgcagagaatgatcagatactcagctacactttttgtgcaggaaaagttgcttggtttgatgtcactgccaaccaaagaacagtttgaggaactgaaaaagaaaaggaaggaggaaatggagaggaagagggccgtggagagacaagctgccctggagtcccagcgaaggcttgaggaaaggcagagtggcctggcttctcgagcggccaacggggaggtggcatctctccgcaggggccctgcccccttgagaaaggctgagggctggctcccactgtcaggaggtcaggggcagagtgaggactcagacccgctcctccagcagatccacaacatcacatcattcatcaggcaggccaaggccgcgggccgcatggatgaagtgcgcactctgcaggagaacctgcggcagctgcaggacgagtatgaccagcagcagacagagaaggccatcgagctgtcccggaggcaggctgaggaggaggacctgcagcgggaacagctgcagatgttgcgtgaacgggagttggaacgagaaagggagcagtttcgggtggcatccctgcacacacggactcggtccctggacttcagagaaatcggcccttttcagctggagcccagcagagagcctcgcacccaccttgcttatgctttggatctaggctcttccccagttccaagcagcacagctcccaagaccccttcacttagctcaactcaacccaccagagtgtggtctgggcccccagccgttggccaggagcgcttaccccagagcagcatgccacagcaacatgaggggccctccttaaacccctttgatgaggaagacctctccagccccatggaagaggccactactggtcctcctgctgcaggggtttccttagacccttcagcccgcatcctgaaagagtacaatcctttcgaggaagaggacgaggaggaggaagcagtggcagggaatccattcattcagccagacagcccagctcctaaccccttcagtgaggaagacgaacatccccagcagaggctctcaagccctctggttcctggtaacccctttgaggaacccacctgtatcaacccctttgagatggacagtgacagtgggccagaggctgaggagcccatagaggaagagctcctcctgcagcagatcgataacatcaaggcatacatctttgatgccaagcagtgcggccgcctggatgaggtagaggtgctgacagagaatctgcgggagctgaagcacaccctggccaagcagaaggggggcactgactgaccagcagtggagagggcacctttgggcccaggggtctggcaggagccagtggagcaggacagagggcaggcaggatggatggggaaggtggcagggtgagaactcagatgcacacaggtgaggggcaggaatctgctgttttgtgttgcgcactttgaggtatttccactacagttgaataataaaatagaaactagaacagggagaatcagcattcagttgctgcttttcctgtttattattactatcttttgtaatcggaggtttaccccttttgaagggactttacatttttactaccgagatataactaaatgcagctctgttgggcccagggcagaaatggctgctgtgtacctcttgggtccatttgctactgcctagtcttggttccttatgcagtattatagggcagcctttttagagcccttcctttagccaagacagagaagatagattccactgagctctattctgctctgacagaagtccatccctagtaggctgtgagttccatttcacctggggccgcctctcccctgctctgcacttcctgtctgtacaatagaagggggaggtgctgctatgaaggggagagtttagacccaggagagcccagcacctctttttaaggtggggtgatgggaatatttcaccagggtctattttctcagtttaagttcttttttgtctctttcaggaagttaagctcccagtgcagggtatcaatgtgaatctggtcctgagctttttagaaaataagagtggtggccgggcgcgctggctcacgcctgtaatcgcaacactttgggaggccgaggcaggcagatcacaaggtcaggagatcgagaccaccctggctaacacagtgaaatcccgtctctactaaaaatacaaaaaattagccaggcgtggtggtgggtgcctgtagtcccagctactttggaggctgaggcaggagaatgctgtgaacccgggaggcagagcttgcagtgagccgagatcgcaccactgcactccagcctgggcagtgagagtgagactccgtctcaaaaaaaaataagagtggttaactttttggttgatattagtattatttgtgagaagagtttccccacccttcttctgatagaacaattgtctgtcactggagaaatctccctccagagctttggcaaagttactctgatctgggtctgtttaaaaggccgggtctctaatttaggaatcggtgatttggaagcttttgcagaacatcaccagaagaagggaagcttcccagagtcagaagctaaattaaaataatttccaaggctatttgatcagccttcttcctttttggttcattgtgtcctgacttggggcactgatgagattttttattttttttgagacagagtttcactttgttgcccaggctggagtgtagtggcatgatctcagctcactgcaacctccacctccctggttcaagtgatatttgtgcctcagccccctgaatagctaggattacaggcgtgggccaccacgcctggttaatctctgtatttttagtagaggtagagtttcaccattttggccaggctggtttcgaactcctggcctcaagtgatctgccaccttggcctcccaaagtgctgggaatacaggcgtgagccactgtgcccgccctgatgagatattttattaccaatgttagtattgagaaactgaaatgtttgaagaagcacaacccaggatcgtgctggtagcaccacagtacttaaactgttggtcaattaaggccagaaagggaaattgttaatttagctctggtgctttggtttacaggaacataactcttaactgacatctgacatcatgatagccatatgtgctcagctctgggtagagtttctgcagttactcatctgaactaatgaacaataactgaccactagtcactttatgccgtgtaactagctctaggccatactttcactggttactggtgtgaaagctgaaattcattttgttacattctggtgaagacccctcttgataatgggaatgttttaactctcttgatgaaaaaataatctgtatttgtgttgatgttcacatttctgtagcacatttcttatccttttggttgaatgaaaagatcttgtataggggtgtggagatggggagtgggtagaagtgtgtgaaggacgctttgcatttgggatctgttcacaaacagccatatgagtgtgttaatgaatgtcagccagttaccaaccctgctggttgttatgggttgttttgagaagttggcaaccaggcatctaagatgttgcctggtacaggcctcttttcttccctgaggcccatgacatttctctgttactctagagggtttctcagatggccagtaggctcctccctgcttagggtctcatttctctgaaaagaggatgaactgaaaagcaggtagttccagaagctaattgctgctttccatcataattatttttcttgtgagaacatttctcttttaattagctagtgattttgattaagactaattcactaaacatacccttccctcaaatcacctcaggtagcaatctgtaagtaactaaaagcattgaaaaacacacaagaaacatttttaaaaactatttttaaaggcctggccgggtgcagtggctcactcctgtaatcccagcactttgggaggccgagacgggtggatcacctgaggtcaggaatttgagactagcatggccaacatggtgaaaccccgtgtctactaaaaatacaaaaattagctgggcgtggtggcagacgcctgtaatcccagctactcagggaggctgaggcacgagaatcgcttgaacctgggaggcggaggttgcagtgagccaagattgcgccactgcactccaacctgggtgacaagagcaagactccgtctcacaaaaaacaaacaaaactgactgattgaatatactaaaccaaactaaaatcatattcttttgattaagtttatccatggctgtattcttctatgaattcttccatttaattcttccacgattatcttctcctgtaaatacatcacaggagttagaattctctacccatcagctgtaccatgtcgcagaattcatgcaggcacaaagttggagttacagagatgggttgacagcaggcaaacttggcctatgtattataaccacaacttcaagttcttacctcatgtgaatattcaccctttctttagtcttccaaggcaaacagccccgtctcatcaccagatgagcaaggtcttgatatggcatagcagatctccctagacacagatcatgagaaaagatggaagagacttagggattcaggcatcagatgaagttggcttttcccttttatgccttgtttgtatttaccctgtctaatacactaaggatacttactcattgtacttgcagctcaatatgtctttgctgttcagatactaaaatgtacctctgagtcattgtgagctgtgtggtaggttggacattggcatagttggtgatgggactcaaaatgaaaaggtggtctctttaccaggtcacagactgtagcagattgtgcttgttatctgacaatgactgtcactttgagggtcgttgatttgcatgcactactctggggccttgtattggagccttttttaaaaaaaataaaatctgagatagag

SEQ ID NO: 173351 - DNA, 903 bp, Homo sapiens
  Payload ID: 14076
  Gene Symbol: RBSN
  Gene Name: rabenosyn, RAB effector
  ENST ID: ENST00000449050
  CDS Start-End: 454-720
ccgagcgaccgatggagatggcggctgcggctgagtgacggacggtggaggcccagagcccgggcctgaagggggggacaaacctgggtgcccgcaggagcccggcagggtgtcttacaagtatcaagaacttactatatgtggttgaataaacaatcaaggtaaagagcatcaagtaaaaacttctgcttgttgataagtacttcagacattcccccagtggctgaagtggcatatgaattatgaagttggatcatttggaatgaatgtaagagaattgccaagggctcctcctactccagagaggaaacctcatccagggccatgaagccacttcctcaccatctgtgtgctgcttaagctaatgctgcgggaaccatggttccttgggaggaatcaagctgactcttggcatgagattcctgccttcctagggttgagagcggcactgccatggcttctctggacgacccaggggaagtgagggagggcttcctctgccctctgtgcctgaaggatctgcagtctttctatcagcttcactcacattacgaggaagaacactcaggggaagaccgtgatgtcaaagggcaaattaaaagtaagaggcgaggaccttgcctatcccctgctgtcgttgagagctttaactcacgggatagttctcatcagctttggtgttgccacaggaatatgataatagtagtagcaaacagatgactagtgtttgtcatgtgccaggcgttttcagagtttccctgtttattaatttcatttaatcctcacaataactgtgtggctgtaagccacatttcgaaccagacacagagagattagataacttgtctgaagccactcagagaaacaatctgactttgagtctagtaaatgtaattgctgtga

SEQ ID NO: 173352 - DNA, 664 bp, Homo sapiens
  Payload ID: 14076
  Gene Symbol: RBSN
  Gene Name: rabenosyn, RAB effector
  ENST ID: ENST00000426541
  CDS Start-End: 1-470
aggacacgctgctcaagagagagcagcagattgatgagaaggagcacacacctgacatcgtgaagctctacgagaaattacgactttgcatggagaaagttgaccagaaagctccagaatacatcaggatggcagcatcattaaatgctggggagacaacctacagtctggaacatgccagtgaccttcgagtggaagtgcagaaagtgtatgagctgatagacgctttaagtaagaagatcttaaccttgggcttgaaccaggaccctccaccacatccaagcaatttgcggctgcagagaatgatcagatactcagctacactttttgtgcaggaaaagttgcttggtttgatgtcactgccaaccaaagaacagtttgaggaactgaaaaagaaaaggaaggaggaaatggagaggaagagggccgtggagagacaaggcctatttttctttcagagcttctgctgattctctcatggctagaataccacagagattgacagttctccctatggcaggagttgcagaggaccaagacattaggaagttccttgtagaacatatcgggtctcccttccgcccacatatacacaaaaacatgacttgattttagcagttggatatctttgtcctgaggctgccctggagtcccagcgaaggct

SEQ ID NO: 173353 - DNA, 1352 bp, Homo sapiens
  Payload ID: 14076
  Gene Symbol: RBSN
  Gene Name: rabenosyn, RAB effector
  ENST ID: ENST00000441057
  CDS Start-End: 600-767
gatggagatggcggctgcggctgagtgacggacggtggaggcccagagcccgggcctgaagggggggacaaacctgggtgcccgcaggagcccggcagggtactgtgctaaaccctggggagacggcgaagtggaaaacatatagagtctgtgccctcccagattttacagtcttacttggtcacttcacgtatgtacctgcggttataaattgagatgagtgctgtgaaggagaagtccattctgatgctctgagtgtcttacaagtatcaagaacttactatatgtggttgaataaacaatcaaggtaaagagcatcaagtaaaaacttctgcttgttgataagtacttcagacattcccccagtggctgaagtggcatatgaattatgaagttggatcatttggaatgaatgtaagagaattgccaagggctcctcctactccagagaggaaacctcatccagggccatgaagccacttcctcaccatctgtgtgctgcttaagctaatgctgcgggaaccatggttccttgggaggaatcaagctgactcttggcatgagattcctgccttcctagggttgagagcggcactgccatggcttctctggacgacccaggggaagtgagggagggcttcctctgccctctgtgcctgaaggatctgcagtctttctatcagcttcactcacattacgaggaagaacactcaggggaagaccgtgatgtcaaagggcaaattaaaaatgttatatctgtttcttgaagctttttgcaagtattctcacatgcattcaataagtgcgtgggcagtagtggggaagcaagaactctgtgtccagttaagcctatggggaacaccagtccacggatggaggtttagctgaatcccatcctggaggtcttgtccagaaggctaaaaaagcaaaggacaggttgttgaaacgagaaggggatgatcgagcagagtcagggacccaaggatatgagtctttcagctatggaggggttgatccttacatgtgggaaccccaggagcttggtgctgtgagaagccatctttccgacttcaaaaaacaccgagctgctagaattgaccactatgttgtggaagtcaataaactaataatcaggttagagaagctcactgcatttgacagaacaaatactgagtctgcaaagattcgagcaatagaaaagtctgtggtgccttgggtcaacgaccaggatgtccctttctgtccagactgtgggaataagttcagcatccggaaccgccgccaccactgccgcctctgcgggtctattatgtgcaagaagtgtatggagctcatcagccttcccttggcaa

SEQ ID NO: 173354 - DNA, 3005 bp, Homo sapiens
  Payload ID: 14076
  Gene Symbol: RBSN
  Gene Name: rabenosyn, RAB effector
  Uniprot ID: Q9H1K0
  ENST ID: ENST00000476527
  CDS Start-End: 474-2828
gcaggcgcacctgccgagttccgagcgaccgatggagatggcggctgcggctgagtgacggacggtggaggcccagagcccgggcctgaagggggggacaaacctgggtgcccgcaggagcccggcagggtgtcttacaagtatcaagaacttactatatgtggttgaataaacaatcaaggtaaagagcatcaagtaaaaacttctgcttgttgataagtacttcagacattcccccagtggctgaagtggcatatgaattatgaagttggatcatttggaatgaatgtaagagaattgccaagggctcctcctactccagagaggaaacctcatccagggccatgaagccacttcctcaccatctgtgtgctgcttaagctaatgctgcgggaaccatggttccttgggaggaatcaagctgactcttggcatgagattcctgccttcctagggttgagagcggcactgccatggcttctctggacgacccaggggaagtgagggagggcttcctctgccctctgtgcctgaaggatctgcagtctttctatcagcttcactcacattacgaggaagaacactcaggggaagaccgtgatgtcaaagggcaaattaaaagtcttgtccagaaggctaaaaaagcaaaggacaggttgttgaaacgagaaggggatgatcgagcagagtcagggacccaaggatatgagtctttcagctatggaggggttgatccttacatgtgggaaccccaggagcttggtgctgtgagaagccatctttccgacttcaaaaaacaccgagctgctagaattgaccactatgttgtggaagtcaataaactaataatcaggttagagaagctcactgcatttgacagaacaaatactgagtctgcaaagattcgagcaatagaaaagtctgtggtgccttgggtcaacgaccaggatgtccctttctgtccagactgtgggaataagttcagcatccggaaccgccgccaccactgccgcctctgcgggtctattatgtgcaagaagtgtatggagctcatcagccttcccttggcaaacaagctcaccagtgccagcaaggagtccctgagcacccacaccagccccagccagtcacccaacagtgtccatggctcccgccgaggcagcatcagcagcatgagcagtgtcagctcggtcctggatgagaaggacgatgaccggatccgctgctgtacacactgcaaggacacgctgctcaagagagagcagcagattgatgagaaggagcacacacctgacatcgtgaagctctacgagaaattacgactttgcatggagaaagttgaccagaaagctccagaatacatcaggatggcagcatcattaaatgctggggagacaacctacagtctggaacatgccagtgaccttcgagtggaagtgcagaaagtgtatgagctgatagacgctttaagtaagaagatcttaaccttgggcttgaaccaggaccctccaccacatccaagcaatttgcggctgcagagaatgatcagatactcagctacactttttgtgcaggaaaagttgcttggtttgatgtcactgccaaccaaagaacagtttgaggaactgaaaaagaaaaggaaggaggaaatggagaggaagagggccgtggagagacaagctgccctggagtcccagcgaaggcttgaggaaaggcagagtggcctggcttctcgagcggccaacggggaggtggcatctctccgcaggggccctgcccccttgagaaaggctgagggctggctcccactgtcaggaggtcaggggcagagtgaggactcagacccgctcctccagcagatccacaacatcacatcattcatcaggcaggccaaggccgcgggccgcatggatgaagtgcgcactctgcaggagaacctgcggcagctgcaggacgagtatgaccagcagcagacagagaaggccatcgagctgtcccggaggcaggctgaggaggaggacctgcagcgggaacagctgcagatgttgcgtgaacgggagttggaacgagaaagggagcagtttcgggtggcatccctgcacacacggactcggtccctggacttcagagaaatcggcccttttcagctggagcccagcagagagcctcgcacccaccttgcttatgctttggatctaggctcttccccagttccaagcagcacagctcccaagaccccttcacttagctcaactcaacccaccagagtgtggtctgggcccccagccgttggccaggagcgcttaccccagagcagcatgccacagcaacatgaggggccctccttaaacccctttgatgaggaagacctctccagccccatggaagaggccactactggtcctcctgctgcaggggtttccttagacccttcagcccgcatcctgaaagagtacaatcctttcgaggaagaggacgaggaggaggaagcagtggcagggaatccattcattcagccagacagcccagctcctaaccccttcagtgaggaagacgaacatccccagcagaggctctcaagccctctggttcctggtaacccctttgaggaacccacctgtatcaacccctttgagatggacagtgacagtgggccagaggctgaggagcccatagaggaagagctcctcctgcagcagatcgataacatcaaggcatacatctttgatgccaagcagtgcggccgcctggatgaggtagaggtgctgacagagaatctgcgggagctgaagcacaccctggccaagcagaaggggggcactgactgaccagcagtggagagggcacctttgggcccaggggtctggcaggagccagtggagcaggacagagggcaggcaggatggatggggaaggtggcagggtgagaactcagatgcacacaggtgaggggcaggaatctgctgttttgtgttgcgcactttgaggtatttccactacagttg

SEQ ID NO: 173355 - DNA, 582 bp, Homo sapiens
  Payload ID: 14076
  Gene Symbol: RBSN
  Gene Name: rabenosyn, RAB effector
  ENST ID: ENST00000507357
  CDS Start-End: 460-582
accgatggagatggcggctgcggctgagtgacggacggtggaggcccagagcccgggcctgaagggggggacaaacctgggtgcccgcaggagcccggcagggtacatacagagggtgtcttacaagtatcaagaacttactatatgtggttgaataaacaatcaaggtaaagagcatcaagtaaaaacttctgcttgttgataagtacttcagacattcccccagtggctgaagtggcatatgaattatgaagttggatcatttggaatgaatgtaagagaattgccaagggctcctcctactccagagaggaaacctcatccagggccatgaagccacttcctcaccatctgtgtgctgcttaagctaatgctgcgggaaccatggttccttgggaggaatcaagctgactcttggcatgagattcctgccttcctagggttgagagcggcactgccatggcttctctggacgacccaggggaagtgagggagggcttcctctgccctctgtgcctgaaggatctgcagtctttctatcagcttcactcacattacgaggaagaacactcaggggaagac

SEQ ID NO: 173356 - DNA, 4679 bp, Homo sapiens
  Payload ID: 14077
  Gene Symbol: RPH3A
  Gene Name: rabphilin 3A
  Uniprot ID: Q9Y2J0
  ENST ID: ENST00000389385
  CDS Start-End: 498-2582
ggcaccgcacacataaatcacgggtgggaggcaggcttggttcccgcttggttccccctgcactgggaagctgccgccccgcttcccttgctcacacagggctttgcagtagtggtggcagccgcggcagaaactggctctggggaagcaattgattcgtctactgccagcagcccggagttgcctacgcggactggaaaggaagggagaagggagagagagagagagagagagagagagagagagagagactcacagagctaaaaccttcatccatgtggaggacagtctgagggagccactgtcccttgtccactgactcactggctggtccgagttttctccgcttctggcagtggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaacgacaacaacaaaaaacccttcctctgtcaccttttctcctcctccctcttctttcccttccatgatagtagattctctctttctcagcctctcccctctcctttctctccctgcctttcttccctttgcctttctctctctctaaagcagtaacaccgcaaaaacaacagcaaaaaaagtgtatgttaacctagcctcacccccttgctctcaccagcctgaccaggaaactgagaaactggcccaaacctgagattccacttgggcccacgcttcttaactgacccactcctcccgttggcagaaccagacattcccagggcttgggccaatggctggcactgccctgagtgcatggcagcatccctcaagctgtgtagatgccccatagaggactctctcatccgtgggctccccgggtgggcacggaggcatttagaagaccagggccatgggtctgaggaagcctcagccaaagcctccagcctttctcctttctccgctcttaggtaaatgaacaagctaccctcctccccaatgcccttgactctgtttcattgactcttttgcatcccatctctcactcagaaccccctccagtctctctgtctctctttgtctgtctctctgtctcctgcactctcgttactaagcttcctgggagaatcaaataatatcatggctatggaacagtagagagagacaggcctgatgccaaaggctttgggctcatcatcaatctttcactttcttcctataaaaaaaattattttataaaggaggaaaaggcaatgtgggcaaacattacaaatttgaggttgaagtcaggcaatcttcaatgccctgtgagaaaggttcgattttcccaattttgatgaagtcttccctcatgaaaatcactcccagtcatcccaaacccctgacattctctacagaagcatcagacagatactcaaactctcactttccccaaatcacatctcttaacttttcaacgccctccaccctcagctccctgcacaattcatgggaggactcatttcttgccttgaataaccattttctaaacatcgagctcttcaccttccccaaggtggccaacagcttcctggctgccatctttccttttgaccttatctttccccattagtccctggtggcacctactctcagcccacctccctcaccacagtttccccttaggagacagcatgctggctgtgtcgcccaagcctgatgctggtgtaggcgctggaatcagcatgcagcaagctcacagtgcccctagtctgggtgcccgctgtccccgacaaatgtaaccacctccctgcctagaatacacacacgtcctccggtgcatgcacaaccacccagcatctttctttgtgatgatgtagccaaaaataaagtaggagcatccaag

SEQ ID NO: 173357 - DNA, 4452 bp, Homo sapiens
  Payload ID: 14077
  Gene Symbol: RPH3A
  Gene Name: rabphilin 3A
  Uniprot ID: Q9Y2J0
  ENST ID: ENST00000415485
  CDS Start-End: 267-2351
tttctttttgtcttggtcctgcatgatttaggggtagttgatgtgtctgtgtgtctacgtgtgtgcactggtgctttgattttattttgggaagagtaggagagtcaaatgaacaattttctttcaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaacgacaacaacaaaaaacccttcctctgtcaccttttctcctcctccctcttctttcccttccatgatagtagattctctctttctcagcctctcccctctcctttctctccctgcctttcttccctttgcctttctctctctctaaagcagtaacaccgcaaaaacaacagcaaaaaaagtgtatgttaacctagcctcacccccttgctctcaccagcctgaccaggaaactgagaaactggcccaaacctgagattccacttgggcccacgcttcttaactgacccactcctcccgttggcagaaccagacattcccagggcttgggccaatggctggcactgccctgagtgcatggcagcatccctcaagctgtgtagatgccccatagaggactctctcatccgtgggctccccgggtgggcacggaggcatttagaagaccagggccatgggtctgaggaagcctcagccaaagcctccagcctttctcctttctccgctcttaggtaaatgaacaagctaccctcctccccaatgcccttgactctgtttcattgactcttttgcatcccatctctcactcagaaccccctccagtctctctgtctctctttgtctgtctctctgtctcctgcactctcgttactaagcttcctgggagaatcaaataatatcatggctatggaacagtagagagagacaggcctgatgccaaaggctttgggctcatcatcaatctttcactttcttcctataaaaaaaattattttataaaggaggaaaaggcaatgtgggcaaacattacaaatttgaggttgaagtcaggcaatcttcaatgccctgtgagaaaggttcgattttcccaattttgatgaagtcttccctcatgaaaatcactcccagtcatcccaaacccctgacattctctacagaagcatcagacagatactcaaactctcactttccccaaatcacatctcttaacttttcaacgccctccaccctcagctccctgcacaattcatgggaggactcatttcttgccttgaataaccattttctaaacatcgagctcttcaccttccccaaggtggccaacagcttcctggctgccatctttccttttgaccttatctttccccattagtccctggtggcacctactctcagcccacctccctcaccacagtttccccttaggagacagcatgctggctgtgtcgcccaagcctgatgctggtgtaggcgctggaatcagcatgcagcaagctcacagtgcccctagtctgggtgcccgctgtccccgacaaatgtaaccacctccctgcctagaatacacacacgtcctccggtgcatgcacaaccacccagcatctttctttgtgatgatgtagccaaaaataaagtaggagcatccaagaaaa

SEQ ID NO: 173358 - DNA, 2581 bp, Homo sapiens
  Payload ID: 14077
  Gene Symbol: RPH3A
  Gene Name: rabphilin 3A
  Uniprot ID: Q9Y2J0
  ENST ID: ENST00000543106
  CDS Start-End: 363-2447
gttcctaacccttgatcttggcttgttaaccctttctgagcttccctttagcggggggatgaggatggtcggctgtttccacatttaagggcagagctgggtgaagggtggtgttagtgctcgagggtcacgcgcgggtggctttgccgcggtggtggcagcggtggcagaggcgacaccgctggaggcggcggagggacgggcccaccaacgctgcaggccggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgag

SEQ ID NO: 173359 - DNA, 561 bp, Homo sapiens
  Payload ID: 14077
  Gene Symbol: RPH3A
  Gene Name: rabphilin 3A
  ENST ID: ENST00000546703
  CDS Start-End: 313-561
agaggcgacaccgctggaggcggcggagggacgggcccaccaacgctgcaggccggttcttgctctgttgcccaggctggactgcagtggcaccagcatggctcactgcagcctcgaccccctaggctcaagtgatcctcctgcttcagcctcctgagtagctgggaccacaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgccta

SEQ ID NO: 173360 - DNA, 570 bp, Homo sapiens
  Payload ID: 14077
  Gene Symbol: RPH3A
  Gene Name: rabphilin 3A
  ENST ID: ENST00000548197
  CDS Start-End: 259-570
ccttctgaagctggacttgaacctgagaaaatgtgacctggggctgctggcggccagcttgtccccgttaggtgacaataagcagacagaagagccaagcagctatggaggaaaatcaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacag

SEQ ID NO: 173361 - DNA, 740 bp, Homo sapiens
  Payload ID: 14077
  Gene Symbol: RPH3A
  Gene Name: rabphilin 3A
  ENST ID: ENST00000551593
  CDS Start-End: 196-740
tttagcggggggatgaggatggtcggctgtttccacatttaagggcagagctgggtgaagggtggtgttagtgctcgagggtcacgcgcgggtggctttgccgcggtggtggcagcggtggcagaggcgacaccgctggaggcggcggagggacgggcccaccaacgctgcaggccggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcag

SEQ ID NO: 173362 - DNA, 534 bp, Homo sapiens
  Payload ID: 14077
  Gene Symbol: RPH3A
  Gene Name: rabphilin 3A
  ENST ID: ENST00000549736
  CDS Start-End: 416-534
gaatttcaggaatattgggagaagtcaccagaaaagaggactgctcccttctgaagctggacttgaacctgagaaaatgtgacctggggctgctggcggccagcttgtccccgttaggtgacaataagcagacagaagagccaagcagctatggaggaaaatcaggtcatcagttgggtcaaagatggagctactagccaggcctgagacctgagcccctggacaccatgtttctattttctgcttctgtgaaattgcctcttctacatacctcatgcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtca

SEQ ID NO: 173363 - DNA, 579 bp, Homo sapiens
  Payload ID: 14077
  Gene Symbol: RPH3A
  Gene Name: rabphilin 3A
  ENST ID: ENST00000551198
  CDS Start-End: 203-579
cttcatccatgtggaggacagtctgagggagccactgtcccttgtccactgactcactggctggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtg

SEQ ID NO: 173364 - DNA, 557 bp, Homo sapiens
  Payload ID: 14077
  Gene Symbol: RPH3A
  Gene Name: rabphilin 3A
  ENST ID: ENST00000551748
  CDS Start-End: 275-557
ctttgccgcggtggtggcagcggtggcagaggcgacaccgctggaggcggcggagggacgggcccaccaacgctgcagggtctcgctctgtcacccaggctggagtgcaggagcagatcatagttcaccgcaacctccgcctcctgggctccagtgatccttccatcttagcctcctgagtagctgggaccacagcccctggacaccatgtttctattttctgcttctgtgaaattgcctcttctacatacctcatgagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatgggg

SEQ ID NO: 173365 - DNA, 538 bp, Homo sapiens
  Payload ID: 14077
  Gene Symbol: RPH3A
  Gene Name: rabphilin 3A
  ENST ID: ENST00000549769
  CDS Start-End: 193-538
atagttcctttgctctgagagtgagcgacagtattagaaaaagtgtgtggtaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtg

SEQ ID NO: 173366 - DNA, 492 bp, Homo sapiens
  Payload ID: 14077
  Gene Symbol: RPH3A
  Gene Name: rabphilin 3A
  ENST ID: ENST00000546426
  CDS Start-End: 456-492
ggtggctttgccgcggtggtggcagcggtggcagaggcgacaccgctggaggcggcggagggacgggcccaccaacgctgcaggccggttcttgctctgttgcccaggctggactgcagtggcaccagcatggctcactgcagcctcgaccccctaggctcaagtgatcctcctgcttcagcctcctgagtagctgggaccacaggtcatcagttgggtcaaagatggagctactagccaggcctgagacctgagcccctggacaccatgtttctattttctgcttctgtgaaattgcctcttctacatacctcatgcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgtt

SEQ ID NO: 173367 - DNA, 595 bp, Homo sapiens
  Payload ID: 14077
  Gene Symbol: RPH3A
  Gene Name: rabphilin 3A
  ENST ID: ENST00000550901
  CDS Start-End: 354-595
agagctaaaaccttcatccatgtggaggacagtctgagggagccactgtcccttgtccactgactcactggctggtccgagttttctccgcttctggcagtggcacctccgctgagcttttaaaccaagtcattgggacttagcgtctttctacccggcagggaagggaggagttggcaagaatttggctcacccattccccctgcaagcctccagcgtcgcgtgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagaggga

SEQ ID NO: 173368 - DNA, 2961 bp, Homo sapiens
  Payload ID: 14077
  Gene Symbol: RPH3A
  Gene Name: rabphilin 3A
  Uniprot ID: Q9Y2J0
  ENST ID: ENST00000551052
  CDS Start-End: 216-2288
ggacagtctgagggagccactgtcccttgtccactgactcactggctggtccgagttttctccgcttctggcagtggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccctttcattccctgtgttgtgtctctgtatatccccagttgtcagcagacccggacaatgctgtgagagaagcattggggcacaaatagagcctccgggctcccactgccccctgagatgtacaccctgattgccaggaaaacagactgctgtgttcagtaacacaccctccctgctccaagtgcaccaggatgcaaatgcacagaattcaccaggggcttggacgctctcctctttccgaatgtcacctgtgtgcttcctagcaaaacaaaaacaaa

SEQ ID NO: 173369 - DNA, 547 bp, Homo sapiens
  Payload ID: 14077
  Gene Symbol: RPH3A
  Gene Name: rabphilin 3A
  ENST ID: ENST00000547099
  CDS Start-End: 36-218
aagcctccagcgtcgcggagcactagacatctactatgactgacaccgtgttcagcaacagttctaaccgttggatgtaccccagtgaccggccccttcaatcaaagttgcagcattctaggtggactttgaaggattggttgtgctttcaagtgtctgttaagagtcttaagccaacaaattgcccttcctctgtagatggtttttccttccactgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgc

SEQ ID NO: 173370 - DNA, 660 bp, Homo sapiens
  Payload ID: 14077
  Gene Symbol: RPH3A
  Gene Name: rabphilin 3A
  ENST ID: ENST00000547728
  CDS Start-End: 170-660
ttttctgctctgaattctgagaaactccaggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaaca

SEQ ID NO: 173371 - DNA, 572 bp, Homo sapiens
  Payload ID: 14077
  Gene Symbol: RPH3A
  Gene Name: rabphilin 3A
  ENST ID: ENST00000552667
  CDS Start-End: 213-572
aaggcatcttagcgctgtccgtggtgctgaccgccaatcccctggttgccgtttcgaccagctgggatctctggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaag

SEQ ID NO: 173372 - DNA, 531 bp, Homo sapiens
  Payload ID: 14077
  Gene Symbol: RPH3A
  Gene Name: rabphilin 3A
  ENST ID: ENST00000547686
  CDS Start-End: 250-531
gagagggaggaagaggagggagaggggcgatggagaaggtcatcagttgggtcaaagatggagctactagccaggcctgagacctgagcccctggacaccatgtttctattttctgcttctgtgaaattgcctcttctacatacctcatgcaacgttcgttctacataattcagcaccagcttagattctcactatcaaattgaaccctttcccctttgctatccacacaggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggg

SEQ ID NO: 173373 - DNA, 562 bp, Homo sapiens
  Payload ID: 14077
  Gene Symbol: RPH3A
  Gene Name: rabphilin 3A
  ENST ID: ENST00000553114
  CDS Start-End: 162-562
gtctttctacccggcagggaagggaggagttggcaagaatttggctcacccattccccctgcaagcctccagcgtcgcggggcaagaagaggagaagaggaagattgtggtccattcatgttctccagccaatactggccaaggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcct

SEQ ID NO: 173374 - DNA, 2429 bp, Homo sapiens
  Payload ID: 14077
  Gene Symbol: RPH3A
  Gene Name: rabphilin 3A
  ENST ID: ENST00000548866
  CDS Start-End: 95-2032
tttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacaacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcggagtggagaccaacaaccgcctgcattctgtgtggctctgcaaaatctgcattgagcagagggaggtgtggaagcgttctggagcgtggttcttcaaaggcttccccaaacaggtcctcccacagcctatgcctataaagaagaccaagccccagcagcctgtcagtgagcctgctgcccctgaacagcctgctcctgagcccaagcaccctgcccgggctccagctcgaggtgacagtgaagataggaggggcccgggtcagaagacaggccctgacccagcctctgctcccgggcgaggaaactatgggcctcccgtgcgcagggcctccgaggcacgaatgagctcatctagccgagattcagagagctgggaccacagtgggggtgctggagactccagccggagcccagcaggtttgagacgggccaactcagtccaggcctccagacctgccccaggctcggtgcagagcccagcgccacctcagcctgggcagccagggaccccaggaggaagcagaccgggtcctgggccagcaggacgctttccagatcagaagccagaggtggctccgagcgaccctgggaccactgccccaccccgagaggagagaacagggggagtcgggggctacccagcagttggagccagagaggaccgaatgagccacccctccggaccctattcccaagcatctgcagctgccccccagcctgctgcagcccgccagccaccacccccagaggaggaggaagaggaagccaacagctacgattcggatgaagcaaccaccctgggtgccctggaattcagccttctctacgaccaggacaacagctccctgcagtgcaccatcattaaggccaagggcctgaagcccatggattcaaacggcttggctgatccctacgttaagctgcacctcctgccgggagccagcaagtccaacaagcttcgtacaaaaactctgcggaatacccggaaccccatctggaatgagaccctcgtgtatcacggcatcaccgatgaggacatgcaaaggaagaccctcaggatctccgtctgtgatgaggacaaatttggccacaatgaatttattggtgagaccagattctccctcaagaaactgaagcccaaccagaggaagaatttcaacatctgcctggagcgagtgattcctatgaaacgtgctgggaccaccgggtcagcccgaggcatggccctttatgaggaagagcaggtggagcgtgttggtgacatcgaggagcgtggcaagatcctggtctccctcatgtacagcacacagcagggaggcctcattgtgggcatcatacgctgcgtgcacctggctgccatggacgctaatggctactcagacccattcgtcaagctctggctgaaaccggacatgggaaagaaggccaaacacaagactcaaattaaaaagaaaaccttgaatcccgaattcaatgaggagtttttctatgacatcaaacacagtgacctggcaaagaagtcactggacatttcagtctgggactatgacatcggcaagtccaatgattacatcggaggctgccagctggggatctctgccaagggagagcgcttaaaacactggtacgagtgtctgaaaaataaagacaagaagatagagcgctggcaccagctacagaatgagaaccacgtgtcaagtgattaggctagtgcccaggtccccatctccatgtcccgggtcccccccagcctgctctagctgcccaccgcaccctgatctctcttctctatgcctacctccccccataccctgctgatctccctgagcctgcctttgagcccccgtcacgttgggcactgctgccaaagactccctcctccctgatgctgggatgtgggctctgaatacagcccctctctcatccctgggatggagcaatggggatggggttggggagacgtttacaaagaggttgatcatttaataacctctcagtttgggtaaattacaaaggttcttcatcatttaggactgtttttagaccctcctagccttgaacacacacatgtacacacacacacacacacacacacacacaccc

SEQ ID NO: 173375 - DNA, 561 bp, Homo sapiens
  Payload ID: 14077
  Gene Symbol: RPH3A
  Gene Name: rabphilin 3A
  ENST ID: ENST00000547840
  CDS Start-End: 181-561
acttttcactttcagaatggcgtccagtaaatcaatcctgggcacctccgctgagcttttaaaccaagtcattgggacttagcgtctttctacccggcagggaagggaggagttggcaagaatttggctcacccattccccctgcaagcctccagcgtcgcggagcactagacatctactatgactgacaccgtgttcagcaacagttctaaccgttggatgtaccccagtgaccggccccttcaatcaaatgataaagaacagctccaggcaggctggtccgtccaccccggtggtcagcctgacaggcagaggaagcaggaagagctgactgatgaggagaaagaaatcatcaacagggtgattgctcgagctgagaaaatggaagagatggagcaggagcgaatcggacgcctggtggaccgcctagaaaacatgaggaagaacgtggctggagatggggtgaaccgctgcatactgtgtggagaacagctggggatgctgggctctgcctgtgtagtatgtgaggactgtaagaagaacgtctgcaccaagtgcgga

SEQ ID NO: 173376 - DNA, 2809 bp, Homo sapiens
  Payload ID: 14078
  Gene Symbol: RPH3AL
  Gene Name: rabphilin 3A-like (without C2 domains)
  Uniprot ID: Q9UNE2
  ENST ID: ENST00000323434
  CDS Start-End: 599-1459
ccaccactgctgcctgtaagggctgttttggatacagaaaatgtgccctttctaacccaaaaaatgcttgaaatgtgtaaaagtggccagactaacagtcccaaagagggctgccctctaagaggaagcgtcccaaatctgttcagttttagagactacgtgactggggtacgtggtggggccttaccagacatccacgaggagaatccaggccttggtttggctccagctgggcctgcctggtggctgccacttattgacttaagtcccagtgattcagctcctcatctggaacacctcgggtcacccccgacaacggtggtgggagggagagcggcctcctcctccctggtggggcctgtctgggtgaagcccctctgttcccgaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccatgggctggcccaggaccgtgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatctgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaa

SEQ ID NO: 173377 - DNA, 2606 bp, Homo sapiens
  Payload ID: 14078
  Gene Symbol: RPH3AL
  Gene Name: rabphilin 3A-like (without C2 domains)
  Uniprot ID: Q9UNE2
  ENST ID: ENST00000331302
  CDS Start-End: 309-1256
ggaacacctcgggtcacccccgacaacggtggtgggagggagagcggcctcctcctccctggtggggcctgtctgggtgaagcccctctgttcccgaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccatgggctggcccaggaccgtgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatctgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaa

SEQ ID NO: 173378 - DNA, 1235 bp, Homo sapiens
  Payload ID: 14078
  Gene Symbol: RPH3AL
  Gene Name: rabphilin 3A-like (without C2 domains)
  Uniprot ID: Q9UNE2
  ENST ID: ENST00000536489
  CDS Start-End: 168-1028
attgacttaagtcccagtgattcagctcctcatctggaacacctcgggtcacccccgacaacggtggtgggagggagagcggcctcctcctccctggtggggcctgtctgggtgaagcccctctgttcccgatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctcc

SEQ ID NO: 173379 - DNA, 487 bp, Homo sapiens
  Payload ID: 14078
  Gene Symbol: RPH3AL
  Gene Name: rabphilin 3A-like (without C2 domains)
  ENST ID: ENST00000573448
  CDS Start-End: 375-487
ccaagcgggtgaggagggttgaggcttctttttccctagaagcttctctgcttcatggagaggtttctcttgggctccttcaacaagcagttcccaggtgggagccgaaatcaggtttcctctgcaaagattctgcctgcctgggactttccagacccacatacatcacgtaaatggaagcaggcctgcgtttctgcattaaaagacaaatagcatgaatgctcgatactgcccgtcccaagccaggtgcccggcagcctgggagcacttgggcattttctgggcagagagtgctcaggggccacaggtacctacgtattattctggtcacgtttgcaatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagac

SEQ ID NO: 173380 - DNA, 566 bp, Homo sapiens
  Payload ID: 14078
  Gene Symbol: RPH3AL
  Gene Name: rabphilin 3A-like (without C2 domains)
  ENST ID: ENST00000575736
  CDS Start-End: 189-566
aaactgggcacctggtgccagcttatggggccttgggcacgtggctgcccctctcgagctggtttcttcttttctgaaaggagtgatgatcacgtcgtcctctggggcttgtgatgattccagttggtcagccagtggcgggcacctggcagatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgag

SEQ ID NO: 173381 - DNA, 692 bp, Homo sapiens
  Payload ID: 14078
  Gene Symbol: RPH3AL
  Gene Name: rabphilin 3A-like (without C2 domains)
  ENST ID: ENST00000574953
  CDS Start-End: 1-474
atcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagagcttttttattttaccatctatcgtgtggagccttctgttttcctgtgagacgccctccagaccccagagtagttcctgagcgctgccttccgggaacttcccctcagctcaccttttgagttggagactgtttccaggatcctgtgttttccctttcttgtttttcacttgtgtttttctggaacccgtcctaagttcttaaaaagagtgtgtgtaagggaaactcagcgtccttatgagtttaaaaacatctgtgttctgccctc

SEQ ID NO: 173382 - DNA, 586 bp, Homo sapiens
  Payload ID: 14078
  Gene Symbol: RPH3AL
  Gene Name: rabphilin 3A-like (without C2 domains)
  ENST ID: ENST00000574722
  CDS Start-End: 141-586
ttgaaattgcaggaggcggttgctccggcctgtctcaagctctgttgggtgccgatggggaaactgaggctcaggaagacagttgacttgttcctggacttctaatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaaggtctggaagaggtcgggggcctggttctacaaagggctccccaagtatatcttgcccctgaagacccctggccgagctgatgacccccacttccg

SEQ ID NO: 173383 - DNA, 814 bp, Homo sapiens
  Payload ID: 14078
  Gene Symbol: RPH3AL
  Gene Name: rabphilin 3A-like (without C2 domains)
  ENST ID: ENST00000577079
  CDS Start-End: 235-814
ccccgacaacggtggtgggagggagagcggcctcctcctccctggtggggcctgtctgggtgaagcccctctgttcccggtaggtgtttcggggtctcatggctccaaggacattggaagatgcctctgttttcctggagtcaggggcccagttcatgcaggggttttcacagaactttgctaacttccggggaaaagatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgaga

SEQ ID NO: 173384 - DNA, 593 bp, Homo sapiens
  Payload ID: 14078
  Gene Symbol: RPH3AL
  Gene Name: rabphilin 3A-like (without C2 domains)
  ENST ID: ENST00000573588
  CDS Start-End: 345-593
agtgctggctttaccagcttctgagcccacaaatgctgttaaggagatagaagccttcttttaagtagatgcaactgtttgcaaagaagaggccctttattttattttatttatttatttttttgcgaatagaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatg

SEQ ID NO: 173385 - DNA, 531 bp, Homo sapiens
  Payload ID: 14078
  Gene Symbol: RPH3AL
  Gene Name: rabphilin 3A-like (without C2 domains)
  ENST ID: ENST00000573780
  CDS Start-End: 95-531
acggttttgccgccagagggcagcgagggagcgcgcgggctgcggggccgaaccccggatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagaga

SEQ ID NO: 173386 - DNA, 820 bp, Homo sapiens
  Payload ID: 14078
  Gene Symbol: RPH3AL
  Gene Name: rabphilin 3A-like (without C2 domains)
  ENST ID: ENST00000576420
  CDS Start-End: 217-820
gaggtgaggggaggaaggttggagaagtacctggcaggacccgcggagagccacctgggagctggagtctgggctgggccgtgcagaagctgctggcggaggcaggggtgtgggacgctgccccccggggcctggagcaccgccctcagcacacctgaggactgggccttttccaagcggatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggccc

SEQ ID NO: 173387 - DNA, 579 bp, Homo sapiens
  Payload ID: 14078
  Gene Symbol: RPH3AL
  Gene Name: rabphilin 3A-like (without C2 domains)
  ENST ID: ENST00000575130
  CDS Start-End: 250-579
agcgagggagcgcgcgggctgcggggccgaaccccggaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtg

SEQ ID NO: 173388 - DNA, 537 bp, Homo sapiens
  Payload ID: 14078
  Gene Symbol: RPH3AL
  Gene Name: rabphilin 3A-like (without C2 domains)
  ENST ID: ENST00000570638
  CDS Start-End: 81-537
agatagcaggcgaggtcagccggggatggccttggctgctggctatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcggggg

SEQ ID NO: 173389 - DNA, 571 bp, Homo sapiens
  Payload ID: 14078
  Gene Symbol: RPH3AL
  Gene Name: rabphilin 3A-like (without C2 domains)
  ENST ID: ENST00000575634
  CDS Start-End: 308-571
gttggaaggactgttctttctccgtcgtatggtctcggcatccttgttgaaagtcagttgaccacggatgtatgggtttatttctgggctctcagttctattccagtgccacagttttcagtaccatatgggcaggaggcatcctgctctgagggagtgtttggtccagtaggagaggtcagacacgttcaccagaaactgcgaagttctgggaagaggtaaaaacagtgtgcttatgaggacgaggcagcgattgcttcagccctgggcaatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatg

SEQ ID NO: 173390 - DNA, 579 bp, Homo sapiens
  Payload ID: 14078
  Gene Symbol: RPH3AL
  Gene Name: rabphilin 3A-like (without C2 domains)
  ENST ID: ENST00000609977
  CDS Start-End: 250-579
agcgagggagcgcgcgggctgcggggccgaaccccggaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtg

SEQ ID NO: 173391 - DNA, 978 bp, Homo sapiens
  Payload ID: 14078
  Gene Symbol: RPH3AL
  Gene Name: rabphilin 3A-like (without C2 domains)
  Uniprot ID: Q9UNE2
  ENST ID: ENST00000608519
  CDS Start-End: 38-898
gatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgt

SEQ ID NO: 173392 - DNA, 2578 bp, Homo sapiens
  Payload ID: 14078
  Gene Symbol: RPH3AL
  Gene Name: rabphilin 3A-like (without C2 domains)
  Uniprot ID: Q9UNE2
  ENST ID: ENST00000618002
  CDS Start-End: 168-1115
attgacttaagtcccagtgattcagctcctcatctggaacacctcgggtcacccccgacaacggtggtgggagggagagcggcctcctcctccctggtggggcctgtctgggtgaagcccctctgttcccgatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccatgggctggcccaggaccgtgggtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatctgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgatcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaatttgcaccgagccagtgtgttgatcgaagaccacgattgcctgtgtttctgagatgcgtccatggaaaaatggaaaaaactgtggtgcgttgacttgctggaacccttcctaa

SEQ ID NO: 173393 - DNA, 1065 bp, Homo sapiens
  Payload ID: 14078
  Gene Symbol: RPH3AL
  Gene Name: rabphilin 3A-like (without C2 domains)
  Uniprot ID: Q9UNE2
  ENST ID: ENST00000608278
  CDS Start-End: 38-985
gatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgt

SEQ ID NO: 173394 - DNA, 531 bp, Homo sapiens; identical to SEQ ID NO: 173385
  Payload ID: 14078
  Gene Symbol: RPH3AL
  Gene Name: rabphilin 3A-like (without C2 domains)
  ENST ID: ENST00000634042
  CDS Start-End: 95-531

SEQ ID NO: 173395 - DNA, 692 bp, Homo sapiens; identical to SEQ ID NO: 173381
  Payload ID: 14078
  Gene Symbol: RPH3AL
  Gene Name: rabphilin 3A-like (without C2 domains)
  ENST ID: ENST00000632671
  CDS Start-End: 1-474

SEQ ID NO: 173396 - DNA, 2608 bp, Homo sapiens
  Payload ID: 14078
  Gene Symbol: RPH3AL
  Gene Name: rabphilin 3A-like (without C2 domains)
  Uniprot ID: Q9UNE2
  ENST ID: ENST00000632616
  CDS Start-End: 309-1256
ggaacacctcgggtcacccccgacaacggtggtgggagggagagcggcctcctcctccctggtggggcctgtctgggtgaagcccctctgttcccgaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccgtgggctggcccaggaccgcagtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatccgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgttcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaattt

SEQ ID NO: 173397 - DNA, 2808 bp, Homo sapiens
  Payload ID: 14078
  Gene Symbol: RPH3AL
  Gene Name: rabphilin 3A-like (without C2 domains)
  Uniprot ID: Q9UNE2
  ENST ID: ENST00000632000
  CDS Start-End: 599-1459
ccaccactgctgcctgtaagggctgttttggatacagaaaatgtgccctttctaacccaaaaaatgcttgaaatgtgtaaaagtggccagactaacagtcccaaagagggctgccctctaagaggaagcgtcccaaatctgttcagttttagagactacgtgactggggtacgtggtggggccttaccagacatccacgaggagaatccaggccttggtttggctccagctgggcctgcctggtggctgccacttattgacttaagtcccagtgattcagctcctcatctggaacacctcgggtcacccccgacaacggtggtgggagggagagcggcctcctcctccctggtggggcctgtctgggtgaagcccctctgttcccgaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctccaaccactgccctcagcccccgaccttatttattaccctcccctcccacacccccaatctacctggtgatgattttaagtttgcgcgtgtcttgggttgggctggggggtttcccacatgcagtgtcagaggggccgcccggtggggctatctccgttgctatattaatggcaagactaaatgaaacctagggcacggcctccgaagctgcgtgtggccccttagaggtgagcatcagagccagagcagtgagggggagactcacccaccctctccctctcccttcagctctgggaggcaggcgcagtgcccccctcccgtgggctggcccaggaccgcagtgaaacctgggtctgtttagtttctttggtttttgtatgtttgtttgtttttgacacagtctcgctttgttgcccaggctggggtgcagtggcacgatcgcggctcactgcaacctccacctcccgggctcaagcgattctctcacctcagcctcctgagtaggtgggattacagatgcccgccaccacacccagttaatttttgtatttttagaagagatggggtttctccatgttggccaggctggtcttgaactcctggtctcaagtgatccgcccgcctcggcctcccaaagtgctgggattacaggtgtgagccaccgcacccaatcctattaggtttctttgaatcccctcatggcctgcctggtttttgctcagcctgtcttcagcttgaggagctgggaagctctggtggatgctatgaactcacttgctgaagagcagcgttcaggtgcatccccagccagggcacgtggctccctcagccatgaattcacttctcttcaggaggtttggcttggcatgaaaatacttcattcagagtatgggcaaatgcttctggaaaacccttccctgaagagagagaacgtgtgtgtgtgtgtcggtgttcacaccctcccatccttcctgcctcctgccccaaaccccgggttcctgggtctggaagggccttctctccaagctgggagctcctgggcccccaccattcactttttgtccttgctgctggcaaacagtaaagaaactcactttccctgtggcacgttatgcttcagaattaaaacaatgaagattaaaa

SEQ ID NO: 173398 - DNA, 518 bp, Homo sapiens
  Payload ID: 14078
  Gene Symbol: RPH3AL
  Gene Name: rabphilin 3A-like (without C2 domains)
  ENST ID: ENST00000632337
  CDS Start-End: 168-518
attgacttaagtcccagtgattcagctcctcatctggaacacctcgggtcacccccgacaacggtggtgggagggagagcggcctcctcctccctggtggggcctgtctgggtgaagcccctctgttcccgatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaag

SEQ ID NO: 173399 - DNA, 1235 bp, Homo sapiens
  Payload ID: 14078
  Gene Symbol: RPH3AL
  Gene Name: rabphilin 3A-like (without C2 domains)
  Uniprot ID: Q9UNE2
  ENST ID: ENST00000632545
  CDS Start-End: 168-1028
attgacttaagtcccagtgattcagctcctcatctggaacacctcgggtcacccccgacaacggtggtgggagggagagcggcctcctcctccctggtggggcctgtctgggtgaagcccctctgttcccgatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggcccgaggaagagtggtttccagtgacagtgacagtgactcggatcttagctcctccagcctagaggacagactcccatccactggggtcagggaccggaaaggcgacaaaccctggaaggagtcaggtggcagcgtggaggcccccaggatggggttcacccacccgccgggccacctctctgggtgccagagcagcctggccagtggtgagacggggacaggctctgctgacccgccagggggaccccgccccgggctgacccgaagggccccggtaaaagacacacctggacgagcccccgctgctgacgcagctccagcaggcccctccagctgcctgggctgaggtgtctggtgcctggaacagacttccctgtggaggattcctgccagaccctgcccggctcctccctgaccggtccttgtgccctcaccagacaccctgttggccatgactcaacaaaccagtgttgggagccgtctgcctccccagctcagtgcctttctgcaccccttctctcctggggagctgtctgcatccgccaccccctcc

SEQ ID NO: 173400 - DNA, 487 bp, Homo sapiens; identical to SEQ ID NO: 173379
  Payload ID: 14078
  Gene Symbol: RPH3AL
  Gene Name: rabphilin 3A-like (without C2 domains)
  ENST ID: ENST00000632511
  CDS Start-End: 375-487

SEQ ID NO: 173401 - DNA, 487 bp, Homo sapiens
  Payload ID: 14078
  Gene Symbol: RPH3AL
  Gene Name: rabphilin 3A-like (without C2 domains)
  ENST ID: ENST00000634137
  CDS Start-End: 375-487
ccaagcgggtgaggagggttgaggcttctttttccctagaagcttctctgcttcatggagaggtttctcttgggctccttcaacaagcagttcccaggtgggagccgaaatcaggtttcctctgcaaagattctgcctgcctgggactttccagacccacatacatcacgtaaatggaagcaggcctgcgtttctgcattaaaagacaaatagcatgaatgctcgatactgcccgtcccaagccaggtgcccggcagcctgggagcacttgggcattttctgggcagagagtgctcaggggccacaggtacctacgtattattctggtcacgtttgcaatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagac

SEQ ID NO: 173402 - DNA, 949 bp, Homo sapiens
  Payload ID: 14078
  Gene Symbol: RPH3AL
  Gene Name: rabphilin 3A-like (without C2 domains)
  ENST ID: ENST00000633184
  CDS Start-End: 599-949
ccaccactgctgcctgtaagggctgttttggatacagaaaatgtgccctttctaacccaaaaaatgcttgaaatgtgtaaaagtggccagactaacagtcccaaagagggctgccctctaagaggaagcgtcccaaatctgttcagttttagagactacgtgactggggtacgtggtggggccttaccagacatccacgaggagaatccaggccttggtttggctccagctgggcctgcctggtggctgccacttattgacttaagtcccagtgattcagctcctcatctggaacacctcgggtcacccccgacaacggtggtgggagggagagcggcctcctcctccctggtggggcctgtctgggtgaagcccctctgttcccgaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaag

SEQ ID NO: 173403 - DNA, 579 bp, Homo sapiens; identical to SEQ ID NO: 173387
  Payload ID: 14078
  Gene Symbol: RPH3AL
  Gene Name: rabphilin 3A-like (without C2 domains)
  ENST ID: ENST00000633332
  CDS Start-End: 250-579

SEQ ID NO: 173404 - DNA, 814 bp, Homo sapiens
  Payload ID: 14078
  Gene Symbol: RPH3AL
  Gene Name: rabphilin 3A-like (without C2 domains)
  ENST ID: ENST00000633301
  CDS Start-End: 235-814
ccccgacaacggtggtgggagggagagcggcctcctcctccctggtggggcctgtctgggtgaagcccctctgttcccggtaggtgtttcggggtctcatggctccaaggacattggaagatgcctctgttttcctggagtcaggggcccagttcatgcaggggttttcacagaactttgctaacttccggggaaaagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgaga

SEQ ID NO: 173405 - DNA, 820 bp, Homo sapiens
  Payload ID: 14078
  Gene Symbol: RPH3AL
  Gene Name: rabphilin 3A-like (without C2 domains)
  ENST ID: ENST00000634169
  CDS Start-End: 217-820
gaggtgaggggaggaaggttggagaagtacctggcaggacccgcggagagccacctgggagctggagtctgggctgggccgtgcagaagctgctggcggaggcaggggtgtgggacgctgccccccggggcctggagcaccgccctcagcacacctgaggactgggccttttccaagcggatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcgggggcctggttctacaaagggctccccaagtatatcttgcccctgaagacccctggccgagctgatgacccccacttccgacctttgcccacggaaccggcagagcgagagcccagaagctctgagaccagccgcatctacacgtgggccc

SEQ ID NO: 173406 - DNA, 571 bp, Homo sapiens; identical to SEQ ID NO: 173389
  Payload ID: 14078
  Gene Symbol: RPH3AL
  Gene Name: rabphilin 3A-like (without C2 domains)
  ENST ID: ENST00000633046
  CDS Start-End: 308-571

SEQ ID NO: 173407 - DNA, 571 bp, Homo sapiens
  Payload ID: 14078
  Gene Symbol: RPH3AL
  Gene Name: rabphilin 3A-like (without C2 domains)
  ENST ID: ENST00000633168
  CDS Start-End: 308-571
gttggaaagactgttctttctccgtcgtatggtctcggcatccttgttgaaagtcagttgaccacggatgtatgggtttatttctgggctctcagttctattccagtgccacagttttcagtaccatatgggcaggaggcatcctgctctgagggagtgtttggtccagtaggagaggtcagacacgttcaccagaaactgcgaagttctgggaagaggtaaaaacagtgtgcttatgaggacgaggcagcgattgcttcagccctgggcaatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatg

SEQ ID NO: 173408 - DNA, 566 bp, Homo sapiens
  Payload ID: 14078
  Gene Symbol: RPH3AL
  Gene Name: rabphilin 3A-like (without C2 domains)
  ENST ID: ENST00000631901
  CDS Start-End: 189-566
aaactgggcacctggtgccagcttatggggccttgggcacgtggctgcccctctcgagctggtttcttcttttctgaaaggagtgatgatcacgtcgtcctctggggcttgtgatgattccagttggtcagccagtggcgggcacctggcagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgag

SEQ ID NO: 173409 - DNA, 654 bp, Homo sapiens
  Payload ID: 14078
  Gene Symbol: RPH3AL
  Gene Name: rabphilin 3A-like (without C2 domains)
  ENST ID: ENST00000634024
  CDS Start-End: 217-654
gaggtgaggggaggaaggttggagaagtacctggcaggacccgcggagagccacctgggagctggagtctgggctgggccgtgcagaagctgctggcggaggcaggggtgtgggacgctgccccccggggcctggagcaccgccctcagcacacctgaggactgggccttttccaagcggatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagag

SEQ ID NO: 173410 - DNA, 531 bp, Homo sapiens
  Payload ID: 14078
  Gene Symbol: RPH3AL
  Gene Name: rabphilin 3A-like (without C2 domains)
  ENST ID: ENST00000633726
  CDS Start-End: 95-531
acggttttgccgccagagggcagcgagggagcgcgcgggctgcggggccgaaccccggatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagaga

SEQ ID NO: 173411 - DNA, 586 bp, Homo sapiens
  Payload ID: 14078
  Gene Symbol: RPH3AL
  Gene Name: rabphilin 3A-like (without C2 domains)
  ENST ID: ENST00000632176
  CDS Start-End: 141-586
ttgaaattgcaggaggcggttgctccggcctgtctcaagctctgttgggtgccgatggggaaactgaggctcaggaagacagttgacttgttcctggacttctaatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaaggtctggaagaggtcgggggcctggttctacaaagggctccccaagtatatcttgcccctgaagacccctggccgagctgatgacccccacttccg

SEQ ID NO: 173412 - DNA, 566 bp, Homo sapiens; identical to SEQ ID NO: 173380
  Payload ID: 14078
  Gene Symbol: RPH3AL
  Gene Name: rabphilin 3A-like (without C2 domains)
  ENST ID: ENST00000632678
  CDS Start-End: 189-566

SEQ ID NO: 173413 - DNA, 491 bp, Homo sapiens
  Payload ID: 14078
  Gene Symbol: RPH3AL
  Gene Name: rabphilin 3A-like (without C2 domains)
  ENST ID: ENST00000633744
  CDS Start-End: 141-491
ttgaaattgcaggaggcggttgctccggcctgtctcaagctctgttgggtgccgatggggaaactgaggctcaggaagacagttgacttgttcctggacttctaatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaag

SEQ ID NO: 173414 - DNA, 518 bp, Homo sapiens
  Payload ID: 14078
  Gene Symbol: RPH3AL
  Gene Name: rabphilin 3A-like (without C2 domains)
  ENST ID: ENST00000632735
  CDS Start-End: 81-518
agatagcaggcgaggtcagccggggatggccttggctgctggctatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagag

SEQ ID NO: 173415 - DNA, 593 bp, Homo sapiens
  Payload ID: 14078
  Gene Symbol: RPH3AL
  Gene Name: rabphilin 3A-like (without C2 domains)
  ENST ID: ENST00000632071
  CDS Start-End: 345-593
agtgctggctttaccagcttctgagcccacaaatgctgttaaggagatagaagccttcttttaagtagatgcaactgtttgcaaagaagaggccctttattttattttatttatttatttttttgcgaatagaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatg

SEQ ID NO: 173416 - DNA, 537 bp, Homo sapiens
  Payload ID: 14078
  Gene Symbol: RPH3AL
  Gene Name: rabphilin 3A-like (without C2 domains)
  ENST ID: ENST00000632610
  CDS Start-End: 81-537
agatagcaggcgaggtcagccggggatggccttggctgctggctatgtgactcccaacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagaggtctggaagaggtcggggg

SEQ ID NO: 173417 - DNA, 672 bp, Homo sapiens
  Payload ID: 14078
  Gene Symbol: RPH3AL
  Gene Name: rabphilin 3A-like (without C2 domains)
  ENST ID: ENST00000632083
  CDS Start-End: 235-672
ccccgacaacggtggtgggagggagagcggcctcctcctccctggtggggcctgtctgggtgaagcccctctgttcccggtaggtgtttcggggtctcatggctccaaggacattggaagatgcctctgttttcctggagtcaggggcccagttcatgcaggggttttcacagaactttgctaacttccggggaaaagatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagag

SEQ ID NO: 173418 - DNA, 746 bp, Homo sapiens
  Payload ID: 14078
  Gene Symbol: RPH3AL
  Gene Name: rabphilin 3A-like (without C2 domains)
  ENST ID: ENST00000633904
  CDS Start-End: 309-746
ggaacacctcgggtcacccccgacaacggtggtgggagggagagcggcctcctcctccctggtggggcctgtctgggtgaagcccctctgttcccgaggatcgtctgccttattgaaaccatctaattggagatccgcagattaggctaccaagacacagctgcctccagcagaatttgtgtagtggacacttgtacgtgcactttggagacagcaagcatgaggcctgcagctgacagctttgagtggctgtgaacctgactatggaaaagatgtgactccccacccccagccgggtgctccgagccatggccgacaccatcttcggcagcgggaatgatcagtgggtttgccccaatgaccggcagcttgcccttcgagccaagctgcagacgggctggtccgtgcacacctaccagacggagaagcagaggaggaagcagcacctcagcccggcggaggtggaggccatcctgcaggtcatccagagggcagagcggctcgacgtcctggagcagcagagaatcgggcggctggtggagcggctggagaccatgaggcggaatgtgatggggaacggcctgtcccagtgtctgctctgcggggaggtgctgggcttcctgggcagctcgtcggtgttctgcaaagactgcaggaagaaagtctgcaccaaatgtgggatcgaggcctcccctggccagaagcggcccctgtggctgtgtaagatctgcagtgagcaaagagag

SEQ ID NO: 173419 - DNA, 593 bp, Homo sapiens; identical to SEQ ID NO: 173384
  Payload ID: 14078
  Gene Symbol: RPH3AL
  Gene Name: rabphilin 3A-like (without C2 domains)
  ENST ID: ENST00000632576
  CDS Start-End: 345-593

SEQ ID NO: 173420 - DNA, 3073 bp, Homo sapiens
  Payload ID: 14079
  Gene Symbol: RACGAP1
  Gene Name: Rac GTPase activating protein 1
  Uniprot ID: Q9H0H5
  ENST ID: ENST00000312377
  CDS Start-End: 69-1967
tctgccgttgggtgaggcgcggagcgaagtgaagggtggcccaggtggggccaggctgactgaaaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgctgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaa

SEQ ID NO: 173421 - DNA, 3229 bp, Homo sapiens
  Payload ID: 14079
  Gene Symbol: RACGAP1
  Gene Name: Rac GTPase activating protein 1
  Uniprot ID: Q9H0H5
  ENST ID: ENST00000427314
  CDS Start-End: 225-2123
gcgaagtgaagggtggcccaggtggggccaggctgactgaatgtatctcctagctatggactaaataatacatggggggaaataaacaagtattcatgagggtgaaaatgtgacccagcaggaaaattacaactattttcaattgacgttgaataggatgagtcatggaatttaagtgatttactgaagattatactactggtagatagaagagctaaagaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgctgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaa

SEQ ID NO: 173422 - DNA, 3080 bp, Homo sapiens
  Payload ID: 14079
  Gene Symbol: RACGAP1
  Gene Name: Rac GTPase activating protein 1
  Uniprot ID: Q9H0H5
  ENST ID: ENST00000454520
  CDS Start-End: 78-1976
gaagtgagtagtgggggtgccagaccaggtgcgtctgccgctggattgtgataggaagcagagtgttcgtgtgaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgctgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatg

SEQ ID NO: 173423 - DNA, 570 bp, Homo sapiens
  Payload ID: 14079
  Gene Symbol: RACGAP1
  Gene Name: Rac GTPase activating protein 1
  ENST ID: ENST00000550149
  CDS Start-End: 104-570
gtgggcgcggcgctgctctgccgttgggtgaggcgcggagcgaagtgaagggtggcccaggtggggccaggctgactgaaaaagatggatactatgatgctgaatgtgcggaatctgtttgagcagcttgtgcgccgggtggagattctcagtgaaggaaatgaagtccgaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccat

SEQ ID NO: 173424 - DNA, 387 bp, Homo sapiens
  Payload ID: 14079
  Gene Symbol: RACGAP1
  Gene Name: Rac GTPase activating protein 1
  ENST ID: ENST00000548961
  CDS Start-End: 7-360
actaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagcagtccctggaggaggattgtgtgtccattttacagctggagaagccgagatccagaaaggacccccaagttgtgggcagaataaatctacagcagcttttaactattaaaccaacttagattttggtagtctttca

SEQ ID NO: 173425 - DNA, 581 bp, Homo sapiens
  Payload ID: 14079
  Gene Symbol: RACGAP1
  Gene Name: Rac GTPase activating protein 1
  ENST ID: ENST00000546764
  CDS Start-End: 165-581
ggagctgtgggcgcggcgctgctctgccgttgggtgaggcgcggagcgaagtgaagggtggcccaggtggggccaggctgactgaagagagccaaaggaaatcaacatttgaattgactacccaatgtcctgcccctgtttctgtcctgtagcacttaggaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctggg

SEQ ID NO: 173426 - DNA, 563 bp, Homo sapiens
  Payload ID: 14079
  Gene Symbol: RACGAP1
  Gene Name: Rac GTPase activating protein 1
  ENST ID: ENST00000552921
  CDS Start-End: 112-563
gtacgtcacaccgtagagggacggcgcgggaggaataaatttctctgtgattggttggtgaaggttttcaaaccggagctgtgggcgcggcgctgctctgccgttggaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttc

SEQ ID NO: 173427 - DNA, 568 bp, Homo sapiens
  Payload ID: 14079
  Gene Symbol: RACGAP1
  Gene Name: Rac GTPase activating protein 1
  ENST ID: ENST00000546786
  CDS Start-End: 160-568
gctctgccgttgggtgaggcgcggagcgaagtgaagggtggcccaggtggggccaggctgactgaagtgagtagtgggggtgccagaccaggtgcgtctgccgctggattgtgataggaagcagagtgttcgtgtgaaagatggatactatgatgctgaatgtgcggaatctgtttgagcagcttgtgcgccgggtggagattctcagtgaaggaaatgaagtccgaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccagg

SEQ ID NO: 173428 - DNA, 530 bp, Homo sapiens
  Payload ID: 14079
  Gene Symbol: RACGAP1
  Gene Name: Rac GTPase activating protein 1
  ENST ID: ENST00000552004
  CDS Start-End: 208-530
aaaccggagctgtgggcgcggcgctgctctgccgttgggtgaggcgcggagcgaagtgaagggtggcccaggtggggccaggctgactgaatgtatctcctagctatggactaaataatacatggggggaaataaacaagtattcatgagggtgaaaatgtgacccagcaggaaaattacaactattttcaattgacgttgaataggatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcat

SEQ ID NO: 173429 - DNA, 554 bp, Homo sapiens
  Payload ID: 14079
  Gene Symbol: RACGAP1
  Gene Name: Rac GTPase activating protein 1
  ENST ID: ENST00000548320
  CDS Start-End: 451-554
ttttcaaaccggagctgtgggcgcggcgctgctctgccgttgggtgaggcgcggagcgaagtgaagggtggcccaggtggggccaggctgactgaagattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgaga

SEQ ID NO: 173430 - DNA, 932 bp, Homo sapiens
  Payload ID: 14079
  Gene Symbol: RACGAP1
  Gene Name: Rac GTPase activating protein 1
  ENST ID: ENST00000552310
  CDS Start-End: 52-932
gaggcgcggagcgaagtgaagggtggcccaggtggggccaggctgactgaaatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggt

SEQ ID NO: 173431 - DNA, 570 bp, Homo sapiens
  Payload ID: 14079
  Gene Symbol: RACGAP1
  Gene Name: Rac GTPase activating protein 1
  ENST ID: ENST00000549777
  CDS Start-End: 184-570
aagtgaagggtggcccaggtggggccaggctgactgaagtgagtagtgggggtgccagaccagtgtatctcctagctatggactaaataatacatggggggaaataaacaagtattcatgagggtgaaaatgtgacccagcaggaaaattacaactattttcaattgacgttgaataggaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaac

SEQ ID NO: 173432 - DNA, 555 bp, Homo sapiens
  Payload ID: 14079
  Gene Symbol: RACGAP1
  Gene Name: Rac GTPase activating protein 1
  ENST ID: ENST00000551260
  CDS Start-End: 64-234
aagtgaagggtggcccaggtggggccaggctgactgaagtgagtagtgggggtgccagaccagatggatactatgatgctgaatgtgcggaatctgtttgagcagcttgtgcgccgggtggagattctcagtgaaggaaatgaaaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactgg

SEQ ID NO: 173433 - DNA, 386 bp, Homo sapiens
  Payload ID: 14079
  Gene Symbol: RACGAP1
  Gene Name: Rac GTPase activating protein 1
  ENST ID: ENST00000552157
  CDS Start-End: 136-386
gcggagcgaagtgaagggtggcccaggtggggccaggctgactgaaaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaag

SEQ ID NO: 173434 - DNA, 586 bp, Homo sapiens
  Payload ID: 14079
  Gene Symbol: RACGAP1
  Gene Name: Rac GTPase activating protein 1
  ENST ID: ENST00000548824
  CDS Start-End: 63-586
agtgaagggtggcccaggtggggccaggctgactgaagtgagtagtgggggtgccagaccagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagacttt

SEQ ID NO: 173435 - DNA, 539 bp, Homo sapiens
  Payload ID: 14079
  Gene Symbol: RACGAP1
  Gene Name: Rac GTPase activating protein 1
  ENST ID: ENST00000551876
  CDS Start-End: 150-539
aaactggcaaaattattatattaatcaataggcttgacttgaagaaccacattttcttgttggtcagtcacttgctaatgaactgacatgctctttcctatttgttttctgctccaagtgattggaggggctgttatattcaaagaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacaga

SEQ ID NO: 173436 - DNA, 2190 bp, Homo sapiens
  Payload ID: 14079
  Gene Symbol: RACGAP1
  Gene Name: Rac GTPase activating protein 1
  Uniprot ID: Q9H0H5
  ENST ID: ENST00000547905
  CDS Start-End: 292-2190
gttttcaaaccggagctgtgggcgcggcgctgctctgccgttgggtgaggcgcggagcgaagtgaagggtggcccaggtggggccaggctgactgaatgtatctcctagctatggactaaataatacatggggggaaataaacaagtattcatgagggtgaaaatgtgacccagcaggaaaattacaactattttcaattgacgttgaatagggagagccaaaggaaatcaacatttgaattgactacccaatgtcctgcccctgtttctgtcctgtagcacttaggaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtga

SEQ ID NO: 173437 - DNA, 2193 bp, Homo sapiens
  Payload ID: 14079
  Gene Symbol: RACGAP1
  Gene Name: Rac GTPase activating protein 1
  Uniprot ID: Q9H0H5
  ENST ID: ENST00000551016
  CDS Start-End: 6-1904
gaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttgggg

SEQ ID NO: 173438 - DNA, 841 bp, Homo sapiens
  Payload ID: 14079
  Gene Symbol: RACGAP1
  Gene Name: Rac GTPase activating protein 1
  ENST ID: ENST00000549342
  CDS Start-End: 1-841
caggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacgggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatgg

SEQ ID NO: 173439 - DNA, 582 bp, Homo sapiens
  Payload ID: 14079
  Gene Symbol: RACGAP1
  Gene Name: Rac GTPase activating protein 1
  ENST ID: ENST00000548598
  CDS Start-End: 69-218
tctgccgttgggtgaggcgcggagcgaagtgaagggtggcccaggtggggccaggctgactgaaaaagatggatactatgatgctgaatgtgcggaatctgtttgagcagcttgtgcgccgggtggagattctcagtgaaggaaatgaagtccgattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaa

SEQ ID NO: 173440 - DNA, 624 bp, Homo sapiens
  Payload ID: 14079
  Gene Symbol: RACGAP1
  Gene Name: Rac GTPase activating protein 1
  ENST ID: ENST00000548644
  CDS Start-End: 93-624
ggtgaggcgcggagcgaagtgaagggtggcccaggtggggccaggctgactgaagagagccaaaggaaatcaacatttgaattgactacccaatgtcctgcccctgtttctgtcctgtagcacttaggatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactgg

SEQ ID NO: 173441 - DNA, 574 bp, Homo sapiens
  Payload ID: 14079
  Gene Symbol: RACGAP1
  Gene Name: Rac GTPase activating protein 1
  ENST ID: ENST00000546723
  CDS Start-End: 110-574
gaagtgaagggtggcccaggtggggccaggctgactgaagtgagtagtgggggtgccagaccaggtgcgtctgccgctggattgtgataggaagcagagtgttcgtgtgatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagat

SEQ ID NO: 173442 - DNA, 551 bp, Homo sapiens
  Payload ID: 14079
  Gene Symbol: RACGAP1
  Gene Name: Rac GTPase activating protein 1
  ENST ID: ENST00000550651
  CDS Start-End: 218-551
gttttcaaaccggagctgtgggcgcggcgctgctctgccgttgggtgaggcgcggagcgaagtgaagggtggcccaggtggggccaggctgactgaatgtatctcctagctatggactaaataatacatggggggaaataaacaagtattcatgagggtgaaaatgtgacccagcaggaaaattacaactattttcaattgacgttgaataggaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacat

SEQ ID NO: 173443 - DNA, 634 bp, Homo sapiens
  Payload ID: 14079
  Gene Symbol: RACGAP1
  Gene Name: Rac GTPase activating protein 1
  ENST ID: ENST00000546595
  CDS Start-End: 179-634
tggggccaggctgactgaagtgagtagtgggggtgccagaccaggtgcgtctgccgctggattgtgataggaagcagagtgttcgtgtgaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccag

SEQ ID NO: 173444 - DNA, 584 bp, Homo sapiens
  Payload ID: 14079
  Gene Symbol: RACGAP1
  Gene Name: Rac GTPase activating protein 1
  ENST ID: ENST00000551145
  CDS Start-End: 211-584
tttctctgtgattggttggtgaaggttttcaaaccggagctgtgggcgcggcgctgctctgccgttgggtgaggcgcggagcgaagtgaagggtggcccaggtggggccaggctgactgaaaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagag

SEQ ID NO: 173445 - DNA, 564 bp, Homo sapiens
  Payload ID: 14079
  Gene Symbol: RACGAP1
  Gene Name: Rac GTPase activating protein 1
  ENST ID: ENST00000548247
  CDS Start-End: 362-564
gcggaacccagcgaaggcgagagaatgaagacacgcatcgggctgtggccagacggttggcagccagggacctagccaagcctccctgcccccgacgcccgcgtccagggatcgtcgatgacagttcgcctgtcgggacatcggatcaggcggccgcccctggggagatgagcaagtcaagccacagctgacctgtgaaaggccgtgtaacagtgactggaagaaccaggaagcctaaacaaatcaggagtatgaaagggagagaacacagtgctgcgggagtttatgccaaaggcacggacccaggcatcagcgtttaagtttaaactgtctagaggaaagatggatactatgatgctgaatgtgcggaatctgtttgagcagcttgtgcgccgggtggagattctcagtgaaggaaatgaagtccgaacgacagattcagctgattcgagagatgctcatgtgtgacacatctggcagcattcaactaagcgaggagcaaaaatcagctctggcttttctcaacagaggccaaccatccagcagcaatgctgggaacaaaag

SEQ ID NO: 173446 - DNA, 6019 bp, Homo sapiens
  Payload ID: 14080
  Gene Symbol: ARHGEF6
  Gene Name: Rac/Cdc42 guanine nucleotide exchange factor (GEF) 6
  Uniprot ID: Q15052
  ENST ID: ENST00000250617
  CDS Start-End: 1207-3537
attaaagttggccttatcataaatttcccaatagtatgcctatttcaagtggttctgaaaatgtttgagaatgatgaagatctcttgttatagacagtttttttttcagagcagtattttaagtgcaaagtgtttttttgttgttgttgttgttgggaaaataagaatcttccatattgtagtgtagacagaggacaagtgctcttttgttctcaaacattctattttttcaagtgtattttacccacttatgtgactgagtctgagcctttgctaagggtactgcagctggattatgtagtggaaccaggtccagaaaaagaattgctaaagaatgcaagtaaacaggatgtcagatgttatccttagcctatttccctaaacatagctttttggctgcaaagtaaaatgccattcttctagcttctgcttatacacagtgatggctgacagcaggcataatcttcgtttgcttggcacgttgtcaccatgcaactcaacgtgttttgcaaggaatgatcgtgacacaccatctctgggagatactatgaggacatccggctatttcttggaagaattttctgtctaccttctttgagccctgttgtgccagcacatctccccatgaggctcagatctgtctgacctaagagccagttggcatcgtcctcctaacagaagccagattttcactggggctagactatttattgacagtgttttcccagactggcccatgagtgtctcatttccaaggtcccctgaagtgctggctcacctctgtttcccaaagcacttgcttgcttgtctctcctccctccccagcatccttttcactttcttcccttataacttcttgcactctgtgtgcgtgtgtgtgtatgcgtgtgtgcatgtgcgtttcttctttttttttatcctaacgaatttgttttgcaggttttgaaaaggaaaaaccagcgttatccaggattgttaaattaattcttatctgtttccacatcttggaccgtgatctctgtggttttaaaatcccatattttgagtgggttccgctgttgtttaagaaaagttgctttaaacctttgctctgcaagcacccgaagagaactcataaaaaggaagacaacagcagatgcaatcgcggatgtggcttagtccttgcagctgccccagagtgctgtttggagtgtaccgtcctcagtaatgaatccagaagaacaaatcgtgacatggcttatatctttgggagttttagagtcccctaaaaagaccatctgtgatccggaggagtttttaaagtcctcgctgaaaaatggggtagttctgtgcaaactgatcaacagactcatgcctggctctgtggaaaagttttgtctggatccccaaactgaagctgactgcatcaacaacatcaatgacttcctgaaaggatgtgcaaccctccaagtggaaatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaataa

SEQ ID NO: 173447 - DNA, 4764 bp, Homo sapiens
  Payload ID: 14080
  Gene Symbol: ARHGEF6
  Gene Name: Rac/Cdc42 guanine nucleotide exchange factor (GEF) 6
  Uniprot ID: Q15052
  ENST ID: ENST00000370620
  CDS Start-End: 414-2282
agtttcgccctggtggcggccgcgctcagggcagggtcccagctccggctgggttgatctgttcccgcagccttggcacaggcttgcccgcccgctcgccggccccgtgactcgggagggcgaacggcttccaggaggcggcggcggcgcggctggagtgagggagcagctggaggacaggcgggcagcggccgagccagatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaataa

SEQ ID NO: 173448 - DNA, 4779 bp, Homo sapiens
  Payload ID: 14080
  Gene Symbol: ARHGEF6
  Gene Name: Rac/Cdc42 guanine nucleotide exchange factor (GEF) 6
  Uniprot ID: Q15052
  ENST ID: ENST00000370622
  CDS Start-End: 429-2297
gccctgaccctgccacttgtgtgaagtcaggatctcctttcccaggcctcagttgagtcatctgtaaaatgaggagactagagtaggggttgggtaatgtctaatggttgtaatgtctgtttttaacttgcccatttccatcagtttccgctaggcaaagctttgcatatttagctgctcagttggaactagtaggaagaccaaagaggattttgatatttgatcctgatgacctttattcaggggtcaatttctccaaggtactgagtactcttttagctgtcaacaaagcaacagaagatcagctatcagaaagaccatgtggacgttcctcttctcttagtgctgctaatacttctcagacaaacccacagggagcagtttctagcacagtttcagggctgcaaaggcagtcaaagacagtggagatgacggaaaatggaagtcatcagttgatagtaaaagcaagattcaactttaagcagactaatgaggatgaactgtcagtttgtaagggggacatcatttacgtcacacgagttgaagaaggaggctggtgggaaggcacattaaatgggagaacaggctggttccccagtaattatgtccgtgaaattaaatccagtgagagacctctctccccaaaagccgtcaaaggatttgaaactgctccacttaccaagaattattatactgtggtgttacagaacatcctggacactgaaaaagaatatgctaaagaacttcagtctcttcttgttacttacttaagacccctgcagtccaataacaatctgagtactgtggaggttacatctttactgggaaacttcgaggaagtatgcacatttcaacagacactctgccaagccttggaagaatgttcaaagtttccagaaaaccagcacaaagtaggaggttgtctactgagtctcatgcctcattttaaatctatgtatctggcttactgtgcaaaccatccttcagctgtaaatgtgctcactcagcacagtgatgagttggaacaattcatggaaaatcaaggtgcatcgagcccaggtatcctcattttaacaacaaacctcagcaaaccattcatgcgactggagaaatatgttactctcttgcaagagttagaacggcatatggaggatactcatccagatcatcaggatattctgaaagcaatcgtagcattcaaaactctcatggggcaatgtcaagatctgaggaagagaaaacagctggagttacagatactgtccgaacctattcaggcatgggaaggagaagatattaaaaacttgggaaatgtgatttttatgtcacaagtaatggtgcagtatggagcatgtgaggaaaaagaggagcggtaccttatgttattttcaaatgtcctgataatgttatctgcaagtcctcggatgagtggctttatctatcagggaaaaataccaatagcaggaacggtggtgactagattagatgaaattgaagggaatgactgcacatttgaaatcactggtaacacagtggagagaattgtggtccattgtaacaacaaccaggacttccaggaatggttggagcagctgaacagactgatcagaggacctgcctcttgcagttcattatccaaaacctcatcgtcatcatgtagtgctcattcttcttttagctctaccggacagccccgaggacccttggagcctcctcaaattataaaaccgtggagtttaagttgtctacgacctgcacctccacttagaccatcagcagcactaggttataaagagaggatgtcttatatcttaaaggagtctagtaaaagccctaaaacgatgaagaaatttcttcataaaaggaagactgagagaaaaccatcggaggaggaatatgtgattaggaaaagtacagctgctctggaagaggatgctcaaatccttaaagtgatcgaagcctactgcaccagcgcaaattttcaacaaggccatggctcaagtactcgaaaagattccattccacaagtcctactccctgaggaagagaaactcatcattgaagaaaccagaagcaacggccagaccatcatggaagaaaagagccttgttgatactgtttacgccttgaaggacgaggtcagagaactgaagcaggaaaataaaagaatgaagcaatgcctggaagaagaactgaaatcaagaagggacctagaaaagctggtgcggaggcttttgaagcaaacagatgagtgtattcgaggcgagtccagtagcaagacctcaattcttccataaccatcactgtgccactgggtggagtgtgccttcagggcatcttgaaatgtcccgctgaatgatttgactcagtttgctcacttctttggcttttgttttgtgtttgagtctctctctctctctccctctctcttctctttctctccccgctgtgtgcatatgtgtgtgcgtgcacgtgcgcgcttgggcatttgctgttgtttggttattggttggttgttcattttttttttcaacaggtgaaaaagcaggaagtggtggtagagatggcctcagagtcttttccattcagtaagaaagagaaagggaatgcaggccagttacttaaaaggtcttcagattgccttcagttcacagtgcctctgcaacagccattgccctcaggtcacattctttgggctggctgcccttgcaaagcagctggccaaggcttattaaatgtgaacccaacttttccccagggctttcctgtacctgcaagcctcttagtacttaatttaccgaaggcaaatcttccagactatggcttgagtaggatgaaagacaaacacatctgcccaatgatccagctgcccttccttagaccatcacatgcctcccctcaatcacaggttttaaaattactgccctatgttgtctataagaccaagaaaactgtagtacccttattccttttgtgtcatgtaaattgtaactcaggggggcagaagctctggtcacccacaccaacaccaaatccatcagcaaattctactggacaatcctcccttttagtagcagagttgaccgccttttcccattgcatgataggtttctttccctcattctgcctagtgtgtaagttttctatttccccagtacttttagccaaccttaccaagtggtgtgtaaactagtatgtatgtgctttgcttactttttaaaaaaatgtagttagactgtgaggagttactttatgtacgttgcatattcaaactgtgatgttttatccttcaaaacaatctgcattaagaagatattgtgccctactagacagctttcattcactttattactctctcatatatgctgtgagaagttgtaatattaattggcctctttgggtgggactctaagcagtatttgcagaaatatgcttctggtccaacttgtacatccagaacaaaagggcccctctagtagctgtgtgctggattattcaggactgattaactcaagttgctcattgaatcacatcatccactttatcccagaaactagaactgtgagaaaccaggtttagaagacagtcacagaacagcacacatccaaattcagcgccattgaaagttggcctaaggctcagtgccactcacccctccctccccaaaagacaagagaaatttggccagatggggaaggtcactggaaattgaggccaaagggctgatcagaattgcctttataatatatttgatggatgcctataaatgtgggttttgcaaatattgtttaaaaaccaaacttgaagccaggcatggtggcccacacctgtggtcccagctactcaggaggctgaggtgggaggatcatttgagcccaggaggtcaaggctgcagtgagctgtgatgacaccactgcactccaacctaggtaacagagagacacctctgtctctgaaaaaacaaaacttgaagtttgaaacccccagcttgctgaggagccctttttatttttggtactgagagtctcaaggtcccatagctacatggtacagggctgttgtctgcttgctgcacagcagaaattacaccatccacaggaaatggactatttttgcagtccaacatcagccaaccacacacagccgtgtttggaagctgaagagtaaagaaatttctaggaatggctgttgttctgttttttagcacagccatttagatataacatccttcacttaaaaattaaaaacatcagtactaccaccaccaccaacaacatcaacacagatcttcacatctgcccattctgtggttagtcaatggcttgcaataaatgtgcaaactgcatctataggaaacatttttgtgattacggaatactttagttgattgctgaaaatattgaaaggtcttcattttacagtgatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaattttctaacttgtttttattttgaagacttttaaaatggacattttcaatacataaaaataaacagtgctttataaaaataa

SEQ ID NO: 173449 - DNA, 1153 bp, Homo sapiens
  Payload ID: 14081
  Gene Symbol: RAD1
  Gene Name: RAD1 checkpoint DNA exonuclease
  Uniprot ID: O60671
  ENST ID: ENST00000325577
  CDS Start-End: 203-409
ggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcata

SEQ ID NO: 173450 - DNA, 2341 bp, Homo sapiens
  Payload ID: 14081
  Gene Symbol: RAD1
  Gene Name: RAD1 checkpoint DNA exonuclease
  Uniprot ID: O60671
  ENST ID: ENST00000341754
  CDS Start-End: 900-1748
catgagctaccatgcccggccatactgttcttgcctgtaaaataacccactgcttaaaaataaataaataacctggcatttagaaataggctctgactccaacttaaaaagtgctttgaattctatcccaggtccatttttcaataaaaacagttaaaaaaaaaaaaaaaaaggcccaaaaagcaacatgtggcagtccttagcacttaggacaaaccatcccacctatctcaggaccttcagaagcattacagtgaaggcattcctggaccttcaagaaatgtttcaataatattaggacacctgttttaaaaagtaaagaatctacctaatgaaatctaaagaatttcttacgaaatgttaactggaaaaattgtggcacttgaaaggataaaaggcattgtgtttttttcgtgagaacactgaacaaatgaagaatatataaaataagtgaaaacataaaaatagggtctcacactgttgcccaggctgaagtgctcacggctcactgcagtttcaagttcctgggctcaaagatgggagtctccctatgttgcccaggctggtctccaacacctgggctcaagtggcttggcctcccaaagcgctgggattataggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggctggaatatttcaggagtttaaagttcaggaagagtctgttacttttcgaattaatttaactgtccttttagactgtttatctatttttggatcaagtcctatgccagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcgggaggctgaggcaggagaattgcttgaacccgggaggcggaggttgtggtgagctgagatgacgccattgcactccagcctaggcaataagagcaaaactctgcctcaaaaaaaaaaaaaaaaaaa

SEQ ID NO: 173451 - DNA, 5770 bp, Homo sapiens
  Payload ID: 14081
  Gene Symbol: RAD1
  Gene Name: RAD1 checkpoint DNA exonuclease
  Uniprot ID: O60671
  ENST ID: ENST00000382038
  CDS Start-End: 1421-2269
gcttgccatcacaccacacggggtcatttacttatcacctactccgcgctagagtactatgctaagtgcggaggacgcaaaaattaatgtcaaagataatccttgttcacagtattctgtctagcttaagaagagttcttagttgaatgaaagctaattctaacaacttgtgtgcacttcttttgaataaaaaccatcaacttatttgaattcttaagtttcctcctaaactccaacatttcaggaggaagaggtcacattctagtcatctttgcaatctcaaacccaaaggaagcctaacttggtacagtgcatggcacattcaatgtctgttgaatacaagtaaagctcatactacctagtctatttttcagtatctcttgagttaatgacctggttaacaagtcagagtcacagtcccaagggcaacaactttttaaaggctcccctaacgtacttcaggatccctgactgagagtggctgactatggcagtatatgggcatactaatcactggagaaataatagcgagaaataaccaaggaaaagcactactctccaaaaacattaaaaaaaaaaaacaactgaacaactagtaagaaagaacgctggatctgagcaccctgtaagtcgcttccccgtgggccgggtaaaggttttaaaacccgccgcctccaggaagacggccacgtgcacaaggattagctgcaaactccgtgcccagtctggccgggagaattgctaaaaccgacctaccgttaacacccgggctactctgaaattaagcaaggctgtagtcaagtaagtaacccaagaaaaggcgcacagagccgccgccgcaggtgtagcccggggacatcccctcctaccttgcaaacggggcctgggatccggtccctctcttcttcctccacctcctctgctgtggcgtgccgcttagctggcggctccgcatctatttcgtttctttttggcttcttcgcctgaactgcaaagcctccacgccgtttcctcttggttgccgccatcttgcctcgccgcccgcgctcttggcctcctttccggcgctgccgctcgctcctatttccgatctctatggttcggcggctctaagcgctcagctccgcggtcgtcctccaggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggctggaatatttcaggagtttaaagttcaggaagagtctgttacttttcgaattaatttaactgtccttttagactgtttatctatttttggatcaagtcctatgccagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcacaatggggaagataggagcaaggtcatgtaccctaatagttactatgttttgtaaatccattttgtagagggcatgtaaataaatgttttcctgtagtcatagattattcaggactgtcctttagttctgtcttttgaactcatgggaataattgtgagtcagcgtaacatttcaagagtctaaaggtggccgggtgtggtggctttaatcccagcactttgggaagccgaggtgggcggatcacctgaggtcaggagttcgagaccagcctgaccaacgtggagaaaccccatctctactaaaaatacaaaaaattagccggacgtggtggcacatgcctgtaatgccagctactcgggaggctgaggcaggagaattgcttgaacccgggaggcggaggttgtggtgagctgagatgacgccattgcactccagcctaggcaataagagcaaaactctgcctcaaaaaaaaaaaaaaaaaaagtctaaaggcttaaagtttgatgcagctacctgaaatgatcttttatttatttattattagaaaaagcaaaggcatatgggcattgcttattagtttgaattctagagactagatcttaaagtagtggttctcaaagtgttgtgcccgcaccaacatcagaatggcctgcaaacttgtagcaaactctggggaggaggccagcattctgtattttaacaagcttccctcaggagattctgatgcctgctaaattttgggaaccactgttttaaaggaaactttttttttctttaatagcatttaattgtatgagatgattgcttttacatgtgatttccttgcaaatgttctgaagttgaggcatcaccaaacaagtctgaacaattctttatgtgatttatttttaaagtagaccttttgaagagatctatgaatgggatataaagcaattttcagtgttacaggttttcttcttcttctcaaaactgtttgctgtaagtaactgcaatcagtacttactactttccatttgcttatgagtttcttgacaaatcaaggtgtagaaaaccagttattaagtgattttgtactttcctggtagttgtcactaaaataatttttgtggcatataaatatatttaataaaatgcaaaaattatcttcctgtctagtagaaaaaattacatgagtaaagtgaagcttctgtctttgttactgtaccaggtgacaacagctgagtgtccctccatggacagtcactattggccttttgagtgagacagttctttaggataaaaacctgtcatcccattgcaggattcatttagcctttctggcccttacccactgatgctagtcattgtgaccaccccacctcccccaaataaaagtgtgccaaactattcattgttgagaaccattcaattgtattcaccaaaattggaggatatattggaatgccctaccttaatataggtcacatagcattagagaaaattggtttggagagtattacagcaaagtgtgctgcaaggaggctactccagcacaatggcaggcactgcttcccaggcatatggacaattctgggaggtggccagggtcagcacctgataactagtaagtgtctcaatctcagcatacaaaatttagcagtgactacaaaagaagttggaattttctaaaatgtttgtattcaagaaggaaacaaatgaatttactaaatgttgtcagagtattttttgtttagataaccaccaagaacagaacaaacctaaaagatacttgggaaaatatctaatcagtcaacattctaaggactgttaaatgtgaaatagcatagttattttttgtcttttgttactagtgtgaacaaagaacggcgcctaacatataatgggcatttagtaactctgttagatgaaagactctccaatttcagattttcttttagcatcttattagtcactacttaattctgatgatttagctctaaatttattttgatctcagtttttttatttttatttttggagacaagatcttgctctgttgcccaggctggagtacagttgtaggattacagttcactccagcctcaatctcctaggctcaagcaatcctcccatctcagcttcccaaatagctacgactacaggtgcatgcctccatgccctgctaatttttgtattttttgtagagatggggttttactatgttccctaggctaatcttgaactcctgagctcaagcaatccacccgcctcggcctcccaaagggctgggattacaggcgtgagctatcatgcctggcctaatgtattttttaaaagttgaatctaaaaagaatttaaaacaaatataaatcagctcagtaaggatggatatttttgtacatttaaaactattattttaggccgggagtggtggctcacacctgtaatcccagcattttgggaagccgaggcagggggatcatctgaggtcaggaagttcgagatcagcctggccaacatggtgaaacccctacctctactaaaaatacaaaaattagctgggtgtggtggtgggtgtctgtaatcccagctacttgagaggctgaggcaagagaatcacttgaaactggaaggcgggggttgcagtgagccgagattgcaccattgcactccagcctgggtgacagagcaagactccgtctcaaaaacaaaaaaaattaaaataaaaattattgttttagctgcatgtcttcagctatttagaattcaaagactaatgaattgtttctaagtcaccctaacatcaaggtacttattttataaagaatttcctccttatttgtgttctaattgacccaggaatttttactttaataaaagtttaactttatttcctatggaaaatcactagggggagtgctccctcaggcagagcaggcgacactttggtgccactacaaattgatgtgtagtatatagaagaatacagtcttatatttaaagacttttagttctgtctttttgaagtttatctctctttctagtaaaatggtgcttactgtgaatggataatcttttttttcatttttcatttgttgatttcccattcgatgatgtagtgcttccaccgagaattgatgaaatgcttcaaaataataaaagtatttgttaaattccactttaataaaaataaggcatgtaacacagtcattttaacaggaagccacagggtttctgtggtgttaccaaagtcctagtaaaaattaattaaaattgctaaaagggcagaatgtggcactctcaacagtggggtaggcagtccttcagaacatagagacttccttctttccttccctgtcttcacattgcttgtcccttatccccacctgaaataaaatctattgggtcctga

SEQ ID NO: 173452 - DNA, 1328 bp, Homo sapiens
  Payload ID: 14081
  Gene Symbol: RAD1
  Gene Name: RAD1 checkpoint DNA exonuclease
  ENST ID: ENST00000513914
  CDS Start-End: 270-524
ctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggggcatggtatggtggctcacacctgtatttccagctgctcaggagaccgaggctgaagcacgaagatcgcttgagctcaggcattaaagaccagcctgggctggaatatttcaggagtttaaagttcaggaagagtctgttacttttcgaattaatttaactgtccttttagactgtttatctatttttggatcaagtcctatgccagggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcattttctgaattggatatgacgagtgaagtcctacaaattaccatgtctcctgacaagccttatttcaggttatctacttttggaaatgcaggaagttcccaccttgactatcccaaagattctgatttgatggaagcatttcattgtaatcagacccaagtcaacagatacaagatttccttactgaaaccctctacaaaggcattagtcctatcttgtaaggtatctattcggacagataacagaggcttcctttcattacagtatatgattagaaatgaagatggacaaatatgttttgtggaatattactgctgccctgatgaagaagttcctgaatctgagtcttgagtatgacaattcactgatatttatgtgtacatttatgatagatgaagttcttattctgagtacagtactctttgtcatttcatattggattttctatagagaagaagcac

SEQ ID NO: 173453 - DNA, 664 bp, Homo sapiens
  Payload ID: 14081
  Gene Symbol: RAD1
  Gene Name: RAD1 checkpoint DNA exonuclease
  ENST ID: ENST00000511456
  CDS Start-End: 172-426
cgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggggcatggtatggtggctcacacctgtatttccagctgctcaggagaccgaggctgaagcacgaagatcgcttgagctcaggcattaaagaccagcctggggactttaactgcacttcgaatgtgttaccaaggttatggttaccctttgatgctgttcctggaagaaggaggagtggtgacagtctgcaaaatcaatacacaggaacctgaggagaccctggactttgatttctgcagcaccaatgttattaataaaattattctgcagtcagaggggctccgtgaagcatttt

SEQ ID NO: 173454 - DNA, 1678 bp, Homo sapiens
  Payload ID: 14081
  Gene Symbol: RAD1
  Gene Name: RAD1 checkpoint DNA exonuclease
  ENST ID: ENST00000628399
  CDS Start-End: 1424-1678
agagcttgccatcacaccacacggggtcatttacttatcacctactccgcgctagagtactatgctaagtgcggaggacgcaaaaattaatgtcaaagataatccttgttcacagtattctgtctagcttaagaagagttcttagttgaatgaaagctaattctaacaacttgtgtgcacttcttttgaataaaaaccatcaacttatttgaattcttaagtttcctcctaaactccaacatttcaggaggaagaggtcacattctagtcatctttgcaatctcaaacccaaaggaagcctaacttggtacagtgcatggcacattcaatgtctgttgaatacaagtaaagctcatactacctagtctatttttcagtatctcttgagttaatgacctggttaacaagtcagagtcacagtcccaagggcaacaactttttaaaggctcccctaacgtacttcaggatccctgactgagagtggctgactatggcagtatatgggcatactaatcactggagaaataatagcgagaaataaccaaggaaaagcactactctccaaaaacattaaaaaaaaaaaacaactgaacaactagtaagaaagaacgctggatctgagcaccctgtaagtcgcttccccgtgggccgggtaaaggttttaaaacccgccgcctccaggaagacggccacgtgcacaaggattagctgcaaactccgtgcccagtctggccgggagaattgctaaaaccgacctaccgttaacacccgggctactctgaaattaagcaaggctgtagtcaagtaagtaacccaagaaaaggcgcacagagccgccgccgcaggtgtagcccggggacatcccctcctaccttgcaaacggggcctgggatccggtccctctcttcttcctccacctcctctgctgtggcgtgccgcttagctggcggctccgcatctatttcgtttctttttggcttcttcgcctgaactgcaaagcctccacgccgtttcctcttggttgccgccatcttgcctcgccgcccgcgctcttggcctcctttccggcgctgccgctcgctcctatttccgatctctatggttcggcggctctaagcgctcagctccgcggtcgtcctccaggtctgtgccgcctccttccggtctcggtggcgcggcacgcgcggctctctaggcctccttcagctctgtggtgacggtggccgaggtggagggccggtctgaagagtggcgggactggcttcacttcctccgcggttcctcggagccgcctcgctcctcttcagggactttgctgagaagggctctcgggcgtccagaccccaccgcaaaggtgtttggcgatccgccgagaagttgttggccccaggagcatccctcggggccgaatgcgcagtggacgatgccccttctgacccaacagatccaagacgaggatgatcagtacagccttgtggccagccttgacaacgttaggaatctctccactatcttgaaagctattcatttccgagaacatgccacgtgtttcgcaactaaaaatggtatcaaagtaacagtggaaaatgcaaagtgtgtgcaagcaaatgcttttattcaggggcatggtatggtggctcacacctgtatttccagctgctcaggagaccgaggctga

SEQ ID NO: 173455 - DNA, 2135 bp, Homo sapiens
  Payload ID: 14082
  Gene Symbol: RAD17
  Gene Name: RAD17 checkpoint clamp loader component
  Uniprot ID: O75943
  ENST ID: ENST00000282891
  CDS Start-End: 313-2067
caagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagca

SEQ ID NO: 173456 - DNA, 3164 bp, Homo sapiens
  Payload ID: 14082
  Gene Symbol: RAD17
  Gene Name: RAD17 checkpoint clamp loader component
  Uniprot ID: O75943
  ENST ID: ENST00000305138
  CDS Start-End: 643-2655
acctgtataccttttgaaacgtcacagtctctaatcgtgaacgatttggggcggagggctgaacaatgtgttttctagtgtgtcgaggtgtttataggctatgtgtgcctccaaactgtaaagtagtccagtatactttccaatgtataagtttgtagaccttaaacttttcttctggctaacttaaaatcgttgaattcactagtttgcataaacatttaagaatttgaaaacacggttgaaaaacagtgttaccaagaaattttgtaataacatgttcaaatgaagacaaaaattttacagtttaagacttaaattcttcgtccacagcaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 173457 - DNA, 2789 bp, Homo sapiens
  Payload ID: 14082
  Gene Symbol: RAD17
  Gene Name: RAD17 checkpoint clamp loader component
  Uniprot ID: O75943
  ENST ID: ENST00000345306
  CDS Start-End: 268-2280
agcccgggtagggccaggtggctgccctttcacctagggtagtccctggtcgcctccgctcttcgcctaaaaggggatgcagctccgggaaatatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 173458 - DNA, 2943 bp, Homo sapiens
  Payload ID: 14082
  Gene Symbol: RAD17
  Gene Name: RAD17 checkpoint clamp loader component
  Uniprot ID: O75943
  ENST ID: ENST00000354312
  CDS Start-End: 422-2434
cgagaggctcggcgttgagcccgggtagggccaggtggctgccctttcacctagggtagtccctggtcgcctccgctcttcgcctaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 173459 - DNA, 3060 bp, Homo sapiens
  Payload ID: 14082
  Gene Symbol: RAD17
  Gene Name: RAD17 checkpoint clamp loader component
  Uniprot ID: O75943
  ENST ID: ENST00000354868
  CDS Start-End: 539-2551
gaggccgtacctccgagaggctcggcgttgagcccgggtagggccaggtggctgccctttcacctagggtagtccctggtcgcctccgctcttcgcctaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaaggtgaattatagtttaatgtactgcaagtcctaaactacggatgggaactattacagtttataatgtcaaaaacttttcttagaccaaaggtatcttccacaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 173460 - DNA, 2648 bp, Homo sapiens
  Payload ID: 14082
  Gene Symbol: RAD17
  Gene Name: RAD17 checkpoint clamp loader component
  Uniprot ID: O75943
  ENST ID: ENST00000358030
  CDS Start-End: 624-2141
caagtgaattcatggtattttacttttttgggaaatactggaaatgaagacctgcaactgtaatttgaaataaggaaaactttaattttcagtataaaaattgctcaaatagaattgcctgattttaatgacaaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 173461 - DNA, 3002 bp, Homo sapiens
  Payload ID: 14082
  Gene Symbol: RAD17
  Gene Name: RAD17 checkpoint clamp loader component
  Uniprot ID: O75943
  ENST ID: ENST00000361732
  CDS Start-End: 481-2493
gcaacgcccgcgagggtcggctcccggggcgctgacaaccgcctcgtggccctcggccggcctctgaagagggcagtgaggggcccccacctgggcgcccgatgcccagagcactctgcgcccccagcctgccccagcccagtccctcccggccgcgcgccctgaccgcaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 173462 - DNA, 2117 bp, Homo sapiens
  Payload ID: 14082
  Gene Symbol: RAD17
  Gene Name: RAD17 checkpoint clamp loader component
  Uniprot ID: O75943
  ENST ID: ENST00000380774
  CDS Start-End: 63-2108
gtgaattatagtttaatgtactgcaagtcctaaactacggatgggaactattacagtttataatgtcaaaaacttttcttagaccaaaggtatcttccacaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcc

SEQ ID NO: 173463 - DNA, 496 bp, Homo sapiens
  Payload ID: 14082
  Gene Symbol: RAD17
  Gene Name: RAD17 checkpoint clamp loader component
  ENST ID: ENST00000507927
  CDS Start-End: 435-496
gggtcggctcccggggcgctgacaaccgcctcgtggccctcggccggcctctgaagagggcagtgaggggcccccacctgggcgcccgatgcccagagcactctgcgcccccagcctgccccagcccagtccctcccggccgcgcgccctgaccggtgaattatagtttaatgtactgcaagtcctaaactacggatgggaactattacagtttataatgtcaaaaacttttcttagaccaaaggtatcttccacaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgt

SEQ ID NO: 173464 - DNA, 803 bp, Homo sapiens
  Payload ID: 14082
  Gene Symbol: RAD17
  Gene Name: RAD17 checkpoint clamp loader component
  ENST ID: ENST00000508320
  CDS Start-End: 1-498
tcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaatgaatggaattcgtattctttcatgtagagagcaacatcttcctacatagtaaataaaagagtaaagaccactgtattgagatgagaaatcaagggaagaaagcaacccaaagctgaaaaaggagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaat

SEQ ID NO: 173465 - DNA, 859 bp, Homo sapiens
  Payload ID: 14082
  Gene Symbol: RAD17
  Gene Name: RAD17 checkpoint clamp loader component
  ENST ID: ENST00000506564
  CDS Start-End: 352-859
ctcgcatcttcagggacagttatctgctttttaaaggagcaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactg

SEQ ID NO: 173466 - DNA, 775 bp, Homo sapiens
  Payload ID: 14082
  Gene Symbol: RAD17
  Gene Name: RAD17 checkpoint clamp loader component
  ENST ID: ENST00000513214
  CDS Start-End: 1-555
tctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaa

SEQ ID NO: 173467 - DNA, 3233 bp, Homo sapiens
  Payload ID: 14082
  Gene Symbol: RAD17
  Gene Name: RAD17 checkpoint clamp loader component
  Uniprot ID: O75943
  ENST ID: ENST00000509734
  CDS Start-End: 679-2724
ccccgggaggccgtacctccgagaggctcggcgttgagcccgggtagggccaggtggctgccctttcacctagggtagtccctggtcgcctccgctcttcgcctaaaaggggatgcagctccgggaaagtaaggccgccgcggttgcggctatattatgtatatgtcttagagacgtgagtctatctctgccttcaagctttcctgggctctcgtcgctcctcctcccgacccgcccatcccatctggggatgagaagattgagggtgcagagccctgtcctgcagcggggatttgcgagctcaacccggcaccccactgattacaggattacgttggacgaatatttgagcttagtattccctgttcactgtgtggggtggtggtgggtcggctaggaatagtcttgaaggtctacctctgacatctcatttcagtaacctcgcatcttcagggacagttatctgctttttaaaggagcaagtgaattcatggtattttacttttttgggaaatactggaaatgaagacctgcaactgtaatttgaaataaggaaaactttaattttcagtataaaaattgctcaaatagaattgcctgattttaatgacaaaaggtgaattatagtttaatgtactgcaagtcctaaactacggatgggaactattacagtttataatgtcaaaaacttttcttagaccaaaggtatcttccacaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 173468 - DNA, 966 bp, Homo sapiens
  Payload ID: 14082
  Gene Symbol: RAD17
  Gene Name: RAD17 checkpoint clamp loader component
  ENST ID: ENST00000512785
  CDS Start-End: 817-966
cggggatttgcgagctcaacccggcaccccactgattacaggattacgttggacgaatatttgagcttagtattccctgttcactgtgtggggtggtggtgggtcggctaggaatagtcttgaaggtctacctctgacatctcatttcagtaacctcgcatcttcagggacagttatctgctttttaaaggagcaagtgaattcatggtattttacttttttgggaaatactggaaatgaagacctgcaactgtaatttgaaataaggaaaactttaattttcagtataaaaattgctcaaatagaattgcctgattttaatgacaaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaa

SEQ ID NO: 173469 - DNA, 2323 bp, Homo sapiens
  Payload ID: 14082
  Gene Symbol: RAD17
  Gene Name: RAD17 checkpoint clamp loader component
  Uniprot ID: O75943
  ENST ID: ENST00000521422
  CDS Start-End: 738-2255
acctccgagaggctcggcgttgagcccgggtagggccaggtggctgccctttcacctagggtagtccctggtcgcctccgctcttcgcctaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagca

SEQ ID NO: 173470 - DNA, 2943 bp, Homo sapiens
  Payload ID: 14082
  Gene Symbol: RAD17
  Gene Name: RAD17 checkpoint clamp loader component
  Uniprot ID: O75943
  ENST ID: ENST00000611523
  CDS Start-End: 422-2434
cgagaggctcggcgttgagcccgggtagggccaggtggctgccctttcacctagggtagtccctggtcgcctccgctcttcgcccaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgccgccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 173471 - DNA, 3164 bp, Homo sapiens
  Payload ID: 14082
  Gene Symbol: RAD17
  Gene Name: RAD17 checkpoint clamp loader component
  Uniprot ID: O75943
  ENST ID: ENST00000612044
  CDS Start-End: 643-2655
acctgtataccttttgaaacgtcacagtctctaatcgtgaacgatttggggcggagggctgaacaatgtgttttctagtgtgtcgaggtgtttataggctatgtgtgcctccaaactgtaaagtagtccagtatactttccaatgtataagtttgtagaccttaaacttttcttctggctaacttaaaatcgttgaattcactagtttgcataaacatttaagaatttgaaaacacggttgaaaaacagtgttaccaagaaattttgtaataacatgttcaaatgaagacaaaaattttacagtttaagacttaaattcttcgtccacagcaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgccgccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 173472 - DNA, 3060 bp, Homo sapiens
  Payload ID: 14082
  Gene Symbol: RAD17
  Gene Name: RAD17 checkpoint clamp loader component
  Uniprot ID: O75943
  ENST ID: ENST00000610770
  CDS Start-End: 539-2551
gaggccgtacctccgagaggctcggcgttgagcccgggtagggccaggtggctgccctttcacctagggtagtccctggtcgcctccgctcttcgcccaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaaggtgaattatagtttaatgtactgcaagtcctaaactacggatgggaactattacagtttataatgtcaaaaacttttcttagaccaaaggtatcttccacaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgccgccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 173473 - DNA, 496 bp, Homo sapiens; identical to SEQ ID NO: 173463
  Payload ID: 14082
  Gene Symbol: RAD17
  Gene Name: RAD17 checkpoint clamp loader component
  ENST ID: ENST00000611548
  CDS Start-End: 435-496

SEQ ID NO: 173474 - DNA, 2789 bp, Homo sapiens
  Payload ID: 14082
  Gene Symbol: RAD17
  Gene Name: RAD17 checkpoint clamp loader component
  Uniprot ID: O75943
  ENST ID: ENST00000616759
  CDS Start-End: 268-2280
agcccgggtagggccaggtggctgccctttcacctagggtagtccctggtcgcctccgctcttcgcccaaaaggggatgcagctccgggaaatatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgccgccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 173475 - DNA, 2648 bp, Homo sapiens
  Payload ID: 14082
  Gene Symbol: RAD17
  Gene Name: RAD17 checkpoint clamp loader component
  ENST ID: ENST00000621274
  CDS Start-End: 624-2141
caagtgaattcatggtattttacttttttgggaaatactggaaatgaagacctgcaactgtaatttgaaataaggaaaactttaattttcagtataaaaattgctcaaatagaattgcctgattttaatgacaaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgccgccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 173476 - DNA, 966 bp, Homo sapiens; identical to SEQ ID NO: 173468
  Payload ID: 14082
  Gene Symbol: RAD17
  Gene Name: RAD17 checkpoint clamp loader component
  ENST ID: ENST00000614140
  CDS Start-End: 817-966

SEQ ID NO: 173477 - DNA, 3233 bp, Homo sapiens
  Payload ID: 14082
  Gene Symbol: RAD17
  Gene Name: RAD17 checkpoint clamp loader component
  ENST ID: ENST00000610584
  CDS Start-End: 679-2724
ccccgggaggccgtacctccgagaggctcggcgttgagcccgggtagggccaggtggctgccctttcacctagggtagtccctggtcgcctccgctcttcgcccaaaaggggatgcagctccgggaaagtaaggccgccgcggttgcggctatattatgtatatgtcttagagacgcgagtctatctctgccttcaagctttcctgggctctcgtcgctcctcctcccgacccgcccatcccatctggggatgagaagattgagggtgcagagccctgtcctgcagcggggatttgcgagctcaacccggcaccccactgattacaggattacgttggacgaatatttgagcttagtattccctgttcactgtgtggggtggtggtgggtcggctaggaatagtcttgaaggtctacctctgacatctcatttcagtaacctcgcatcttcagggacagttatctgctttttaaaggagcaagtgaattcatggtattttacttttttgggaaatactggaaatgaagacctgcaactgtaatttgaaataaggaaaactttaattttcagtataaaaattgctcaaatagaattgcctgattttaatgacaaaaggtgaattatagtttaatgtactgcaagtcctaaactacggatgggaactattacagtttataatgtcaaaaacttttcttagaccaaaggtatcttccacaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgccgccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 173478 - DNA, 2323 bp, Homo sapiens
  Payload ID: 14082
  Gene Symbol: RAD17
  Gene Name: RAD17 checkpoint clamp loader component
  ENST ID: ENST00000611001
  CDS Start-End: 738-2255
acctccgagaggctcggcgttgagcccgggtagggccaggtggctgccctttcacctagggtagtccctggtcgcctccgctcttcgcccaaaaggggatgcagctccgggaaacaagtgaattcatggtattttacttttttgggaaatactggaaatgaagacctgcaactgtaatttgaaataaggaaaactttaattttcagtataaaaattgctcaaatagaattgcctgattttaatgacaaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgccgccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagca

SEQ ID NO: 173479 - DNA, 803 bp, Homo sapiens
  Payload ID: 14082
  Gene Symbol: RAD17
  Gene Name: RAD17 checkpoint clamp loader component
  ENST ID: ENST00000617338
  CDS Start-End: 1-498
tcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaatgaatggaatccgtattctttcatgtagagagcaacatcttcctacatagtaaataaaagagtaaagaccactgtattgagatgagaaatcaagggaagaaagcaacccaaagctgaaaaaggagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaat

SEQ ID NO: 173480 - DNA, 3002 bp, Homo sapiens
  Payload ID: 14082
  Gene Symbol: RAD17
  Gene Name: RAD17 checkpoint clamp loader component
  Uniprot ID: O75943
  ENST ID: ENST00000620889
  CDS Start-End: 481-2493
gcaacgcccgcgagggtcggctcccggggcgctgacaaccgcctcgtggccctcggccggcctctgaagagggcagtgaggggcccccacctgggcgcccgatgcccagagcactctgcgcccccagcctgccccagcccagtccctcccggccgcgcgccctgaccgcaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgccgccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaatttaa

SEQ ID NO: 173481 - DNA, 775 bp, Homo sapiens
  Payload ID: 14082
  Gene Symbol: RAD17
  Gene Name: RAD17 checkpoint clamp loader component
  ENST ID: ENST00000613417
  CDS Start-End: 1-555
tctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgccgccaaactcagctattgccataccttgctctactaaccattccaatgagaaatcaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaa

SEQ ID NO: 173482 - DNA, 3057 bp, Homo sapiens
  Payload ID: 14082
  Gene Symbol: RAD17
  Gene Name: RAD17 checkpoint clamp loader component
  Uniprot ID: O75943
  ENST ID: ENST00000616683
  CDS Start-End: 538-2550
gaagattgagggtgcagagccctgtcctgcagcggggatttgcgagctcaacccggcaccccactgattacaggattacgttggacgaatatttgagcttagtattccctgttcactgtgtggggtggtggtgggtcggctaggaatagtcttgaaggtctacctctgacatctcatttcagtaacctcgcatcttcagggacagttatctgctttttaaaggagcaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgcctccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 173483 - DNA, 2135 bp, Homo sapiens
  Payload ID: 14082
  Gene Symbol: RAD17
  Gene Name: RAD17 checkpoint clamp loader component
  ENST ID: ENST00000616158
  CDS Start-End: 313-2067
caagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgccgccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagca

SEQ ID NO: 173484 - DNA, 859 bp, Homo sapiens; identical to SEQ ID NO: 173465
  Payload ID: 14082
  Gene Symbol: RAD17
  Gene Name: RAD17 checkpoint clamp loader component
  ENST ID: ENST00000613281
  CDS Start-End: 352-859

SEQ ID NO: 173485 - DNA, 2117 bp, Homo sapiens
  Payload ID: 14082
  Gene Symbol: RAD17
  Gene Name: RAD17 checkpoint clamp loader component
  ENST ID: ENST00000621806
  CDS Start-End: 63-2108
gtgaattatagtttaatgtactgcaagtcctaaactacggatgggaactattacagtttataatgtcaaaaacttttcttagaccaaaggtatcttccacaaaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgccgccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcc

SEQ ID NO: 173486 - DNA, 3057 bp, Homo sapiens
  Payload ID: 14082
  Gene Symbol: RAD17
  Gene Name: RAD17 checkpoint clamp loader component
  Uniprot ID: O75943
  ENST ID: ENST00000616488
  CDS Start-End: 538-2550
gaagattgagggtgcagagccctgtcctgcagcggggatttgcgagctcaacccggcaccccactgattacaggattacgttggacgaatatttgagcttagtattccctgttcactgtgtggggtggtggtgggtcggctaggaatagtcttgaaggtctacctctgacatctcatttcagtaacctcgcatcttcagggacagttatctgctttttaaaggagcaagtgaattcatggtattttacttttttgggaaatactggaaatgaagacctgcaactgtaatttgaaataaggaaaactttaattttcagtataaaaattgctcaaatagaattgcctgattttaatgacaaaagtatatgggagtccacatttatgtaagaaatgaaactataaaatgtataaataatttgcaaatcagaattgctgtcgaaagttttactataatgaaagatattttcatactctcaaaaatatagaggaaaggggccaagattatagtaccagtcacaatcttttgatgaggacgaaatgaatcaggtaacagactgggttgacccatcatttgatgattttctagagtgtagtggcgtctctactattactgccacatcattaggtgtgaataactcaagtcatagaagaaaaaatgggccttctacattagaaagcagcagatttccagcgagaaaaagaggaaatctatcttccttagaacagatttatggtttagaaaattcaaaagaatatctgtctgaaaatgaaccatgggtggataaatataaaccagaaactcagcatgaacttgctgtgcataaaaagaaaattgaagaagtcgaaacctggttaaaagctcaagttttagaaaggcaaccaaaacagggtggatctattttattaataacaggtcctcctggatgtggaaagacaacgaccttaaaaatactatcaaaggagcatggtattcaagtacaagagtggattaatccagttttaccagacttccaaaaagatgatttcaaggggatgtttaatactgaatcaagcttccatatgtttccctatcagtctcagatagcagttttcaaagagtttctactaagagcgacaaagtataacaagttacaaatgcttggagatgatctgagaactgataagaagataattctggttgaagatttacctaaccagttttatcgggattctcatactttacatgaagttctaaggaagtatgtgaggattggtcgatgtcctcttatatttataatctcggacagtctcagtggagataataatcaaaggttattgtttcccaaagaaattcaggaagagtgttctatctcaaatattagtttcaaccctgtggcaccaacaattatgatgaaatttcttaatcgaatagtgactatagaagctaacaagaatggaggaaaaattactgtccctgacaaaacttctctagagttgctctgtcagggatgttctggtgatatcagaagtgcaataaacagcctccagttttcttcttcaaaaggagaaaacaacttacggccaaggaaaaaaggaatgtctttaaaatcagatgctgtgctgtcaaaatcaaaacgaagaaaaaaacctgatagggtttttgaaaatcaagaggtccaagctattggtggcaaagatgtttctctgtttctcttcagagctttggggaaaattctatattgtaaaagagcatctttaacagaattagactcacctcggttgccctctcatttatcagaatatgaacgggatacattacttgttgaacctgaggaggtagtagaaatgtcacacatgcctggagacttatttaatttatatcttcaccaaaactacatagatttcttcatggaaattgatgatattgtgagagccagtgaatttctgagttttgcagatatcctcagtggtgactggaatacacgctctttactcagggaatatagcacatctatagctacgagaggtgtgatgcattccaacaaagcccgaggatatgctcattgccaaggaggaggatcaagttttcgacccttgcacaaacctcagtggtttctaataaataaaaagtatcgggaaaattgcctggcagcaaaagcactttttcctgacttctgcctaccagctttatgccgccaaactcagctattgccataccttgctctactaaccattccaatgagaaatcaagctcagatttcttttatccaagatattggaaggctccctctgaagcgacactttggaagattgaaaatggaagccctgactgacagggaacatggaatgatagaccctgacagcggagatgaagcccagcttaatggaggacattctgcagaggaatctctgggtgaacccactcaagccactgtgccggaaacctggtctcttcctttgagtcagaatagtgccagtgaactgcctgctagccagccccagcccttttcagcccaaggagacatggaagaaaacataataatagaagactacgagagtgatgggacatagaagccagcctgctaatcagattgctacttcacagcttcatttttgtttcattcagtggtacttcagcagagttaatatgcttttctgatgaattacacaacagtttgttaattcttcattcttgtagtatttcatcacaagaaacctactcttctgtcatcttgaagtaaatagaagatcaagccttcaaatctcttaattttttcggtatttattaaatctgtgagtggtttaaggagcggtcagtgtgtataaagtgtgtttgaacattatgccaaatatcaagatgtgaaggactaattcaggatgcaaaaacgttattggggggttgtaaatatcaactattcaacagtttaggatgcaattacgagtgtaaactgtgtgccttatttacactttattgtctcccgcttctcagatagttttgatgtgttgtacagtggaatatcttagatactttttggaaagtatttacataagttatatcacaattaaaatgttgaattt

SEQ ID NO: 173487 - DNA, 5886 bp, Homo sapiens
  Payload ID: 14083
  Gene Symbol: RAD18
  Gene Name: RAD18 E3 ubiquitin protein ligase
  Uniprot ID: Q9NS91
  ENST ID: ENST00000264926
  CDS Start-End: 118-1605
cccgcctctggcgcgtcgcgggctgctgacgtaatgcggtagcgcggggaatttcgagtggtgttggagcgccggaggctagtgggtggctgacccccagcatcctcgggagcgaccatggactccctggccgagtctcggtggcctccgggcctggcagtcatgaagacaatagatgatttgctgcggtgtggaatttgcttcgagtatttcaacattgcaatgataatacctcagtgttcacataactactgctctctctgtataagaaaatttctgtcctataaaactcagtgtccaacttgctgtgtgactgtcacagagccggatctgaaaaataaccgcatattagatgaactggtaaaaagcttgaattttgcacggaatcatctgctgcagtttgctttagagtcaccagccaaatctcctgcttcttcctcttcaaagaatcttgctgtcaaagtatatactcctgtagcctccagacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgttctgtagaagagatcgctccagatccctcagaggctaagcgtcctgagccaccctcgacatccactttgaaacaagttactaaagtggattgtcctgtttgcggggttaacattccagaaagtcacattaataagcatttagacagctgtttatcacgcgaagagaagaaggaaagcctcagaagttctgttcacaaaaggaagccgctgcccaaaactgtatataatttgctctctgatcgtgatttaaagaaaaagctaaaagagcatggattatctattcaaggaaataaacaacagctcattaaaaggcaccaagaatttgtacacatgtacaatgcccaatgcgatgctttgcatcctaaatcagctgctgaaatagttcgagaaatcgaaaatatagagaagactaggatgcgtcttgaagctagtaaactcaatgaaagtgtaatggtttttacaaaggaccaaacagaaaaggaaatagatgaaatccacagtaaatatcgtaaaaaacataagagtgaatttcagcttctggtggatcaggctagaaaaggatacaagaaaattgctggaatgtcacaaaaaacagtaacaataacaaaagaagatgaatctacagaaaagctatcttctgtatgcatgggacaggaagataatatgacctcagtaacaaaccacttttctcaatcaaagctggactccccagaggaattggaacctgacagagaagaggattcttctagctgtattgatattcaagaagttctttcttcatcagaatcagattcatgcaatagttccagttcagacatcataagagatcttttagaagaagaggaagcctgggaagcatcacataaaaacgatcttcaagacacagaaataagtccaagacagaatcgccgcacaagagccgctgaaagtgctgagattgaaccaagaaacaagcgtaataggaattaatgtgggcttttgctgacttttcaaatgcattgattagaataccgtacttttggttgccacagatagattttctatttataaatgcccaaggaaagatgctaaattctaaatattacggttagctgatattcattcttttctgcttttccagaggggaaaaatgttacaaaatatccttacttggtcagttgcctcctgcctctaaaacatctctctctaaaaatactgacatttcacacaggtaccagctttgcagaggaggtagactctttggcactttggcacagggatttggtttggtttggtttggtttgataattaaatttcagaatgtccttaggccattctccttctcttccatggagaatccagcctcacaaaaggattctttcaacttctttattgcaagaaacagttgagttaaatgtttgtttttggaaaggcgggatgtcagttcacatccttggtgtgtgtaagtaccgatgcacgccaccaccatgcctgtgttacagcagctccatgatggttgttgcccgaggttaatgtagttgtttgttagacctgtgtcttacacatttctcagagtaggatattagtattataatttaaagctacgacagtcacaaagtcacaataacttagaaacattgcgcatattcttctgaaatagcacttaaaaatgattagtgtcagtattttttcacttgggtcaatcaaatctgtaacactgaatccaagctattaaacaaaaagtatgcaatgaatgaattttgtaaatgaatagagagtatcagtttacaataatgttcttaaaacagtatcctctggatagttgagtatgggttagaaatcattgaaatggattggtcagaaattgctatctgtgtaaaatgtctaccagtagccagatgcttccagagttcttaatgcctctctggcatttcagagccagcatcccccaactcccacccctctgccatcacccaacccaaacacatcagctttcaaatgagatgatagtaaatgcggcaatgttaagacaagaaatttatgatttgccagattcaacatttatgacctccccttccaaagactgtctccgttgaccttgtctttttggtatgccttggggtttctgataatgtgtggagtctcattatggctgagagtttagtgttttcacagtgaagtgcagacatttgatttctttatgagttccctgtgttagaaatggctatagaaaaatttgtcataataatttcatttgcatgaaatcctgaggggtgcattaaggaaactaaaagcaccacttaccaaatctatcggcagaactgatgtgaggtaagtgagcatgtcaaacaaaataggagctcacatggatatatttatgtcactgagttgtcagaaattatgtcaaaatgaaaactgtttgtttcatgacaaattatatagtctataaattaaactggaagtaattattactttaattgcagcaaaaggagtttgtgagggagcggtgagacccaagattgggaaagtaggcacatgagttcattcagcaaatatttggttatctatgtctgtcactgtgctgacactgggaatacaaaggtggccaaagatcatctagaacaatggttcccagtggggtgggcagaaagattttgccccccaggagacagctggcaatgtgtggagacacttttggaggtggagggtggtgaggggtactaccagtatcaatgggtggaggccagggatgaggctaaacacccaaccctcatggattagtttgccagggctgccgtcacaagatactgcagacggggaagcttacacaacagaaatgtgtattctcagaattctggaggctggaagtccaagatcagtagggtttcttcttcggcctctctccttggcttccactcatggtgtccttgcatggtcttttctctgtgtgcacatgactgtgcaggactggtgtcccgatttcttgtagggacagcagtcattggatcagggcccatgcgtatggcctcattttacttcagttacctcttttttagatagagggccctatctctaaatactgtcacattctgagataccggcagttaagacttccaacatatttagtggtaggggttaaggggcacgctttagactacaacactccacagtaaagaattatccagtctaacatgtcagttgtgccaagactgagaaacctgtaatgtaaaggaactcccaagtctacctgaaaagtaaggtctaaagagcatttattgagcactatctgttagcacttagcatatgtttaatattcatacattgaaagaaatgtatgttcatatccatctgacaaagattaaggaacttagagtaagtaatagatccaaaattgaaactgataaacttctggttctaaaattcaccttttagtgaaaatacagtttctcaccaaacttacagtaattcagagttattaactctttctacctcctcactcccctcaaagttataacatctcccatcaacatcagctcagaatggcagtgatgcttatggtttgtgggggtgcaggtgagctgctggatgcactttagatggcctagtatgccaggccgtcctttcatcctctactctcgtctttctttttcgacctcatgttgaggattactggtctagttgaaaaaagaattcatacacataagaccatgtatataatagagggaggtatgcctttaaaaacaaaattacatggtaaagactgatgtgtcaacagggatagacaacatagagaaggctagaactgtttctggaaaaaaacccaaaaacaatggatttcaaacttcttagcatccgataaaagaaagtagcaattattcaaatgagaaacacttctgtctgttatgtacatattatgaaagtatgaacataagagggaaaaccacaaccattacattttttaccatttcagtaatttttttttggtttttagtctgtttttagacatccttaagaacaactatctgaggctgtaaacaagtatttacattaacacccatgatactgactttatactccctacctgcattgagaccttaaagggggcatttctccattccttctgtgtatttctgggtatccccaggttcagatattcagaatacagatacaagtccatgcttgcatatgttgctgctccccccgacagacttctaccagcatctgccctcctcaccgctgctctgtcacgtgcactgcggctggccctgctggaaagtcctaccttgcctaggacgccatccccgatatagccccaagatgcaaacctgccaagtgctagggcagccctgccttcctgtccatttcagtctcttggccttgctgtgttccaagtggaaatgggagtgtgctttcctggtttgctagtgtactatcacccggaccacagcgtcctgtgcaaaaatttgcttcctctctcttcccctttcactctttctcttttctcttccccacccccttttttttctctttccccttacctttctttcctttccactcttcctgtccttccttccttcaactattaggactatatgtcaagtaatgtgcaaaacaaagacagttcctgccctgatggagcttgtagatcagaagggaagatgagcattaagtaattatatagattaatgtacaactgtgatgagtgcaacaaaagagaggttcatggcactatcaaacatgcaatggacggattttgtttttgcctataaactcttgccatagaaagcttgaaaatcagtccagggggacagcattaatcaccatgttctttccttatccctgtcttccccaaaattcatgtgttgaaacttaacaagaggtgggaactttaggatgtgattaagtcgtgagggcacagctcttatagatggggtcacggtccttctaaaagggcttgagggagtggttttgtttccttccatcccttccgccacatgaggacacagtcttcgttccctctggaggactcagcaacaacacaccatcttggaagcagagagcagtcctcaccagacacggaatctgccagtgccttgatcttggacttaccagcctccatacctgtgagaaataaatttctattgtctataagttacccagactgtggtattttcttctggcagcacaaatggacacccagaaactgatgcatgcatcttctgactcctttgattccaaaatacaaaatattagaataaagttatggaagtc

SEQ ID NO: 173488 - DNA, 516 bp, Homo sapiens
  Payload ID: 14083
  Gene Symbol: RAD18
  Gene Name: RAD18 E3 ubiquitin protein ligase
  ENST ID: ENST00000429790
  CDS Start-End: 1-240
ctatcttctgtatgcatgggacaggaagataatatgacctcagtaacaaaccacttttctcaatcaaagctggactccccagaggaattggaacctgacagagaagaggattcttctagctgtattgatattcaagaagttctttcttcatcagaatcagattcatgcaatagttccagttcagacatcataagagatcttttagaagaagaggaagcctgggaagcatcacataagtgagttctcataatcatgaaataagcatgcactttgacctgagaaattatacttctatgcagctgattttcaaacaaaattatatttttgctttctggtttaaagaagtagtaatcctcatgcaaggtaaagattttcagtttactacttgtttctatatatttctgctaagaaatggaatcctatgtaataactgtagttatgtatcagatgttatttctgtatggataaattgttcttatgggcaattaatacagtcatgcatcacttaacaatggg

SEQ ID NO: 173489 - DNA, 563 bp, Homo sapiens
  Payload ID: 14083
  Gene Symbol: RAD18
  Gene Name: RAD18 E3 ubiquitin protein ligase
  ENST ID: ENST00000418463
  CDS Start-End: 86-247
aatgcggtagcgcggggaatttcgagtggtgttggagcgccggaggctagtgggtggctgacccccagcatcctcgggagcgaccatggactccctggccgagtctcggtggcctccgggcctggcagtcatgaagacaatagatgatttgctgcggtgtggaatttgcttcgagtatttcaacattgcaatgataatacctcagtgttcacataactactgtcacagagccggatctgaaaaataaccgcatattagatgaactggtaaaaagcttgaattttgcacggaatcatctgctgcagtttgctttagagtcaccagccaaatctcctgcttcttcctcttcaaagaatcttgctgtcaaagtatatactcctgtagcctccagacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgttctgtagaagagatcgctcca

SEQ ID NO: 173490 - DNA, 582 bp, Homo sapiens
  Payload ID: 14083
  Gene Symbol: RAD18
  Gene Name: RAD18 E3 ubiquitin protein ligase
  ENST ID: ENST00000421052
  CDS Start-End: 86-466
aatgcggtagcgcggggaatttcgagtggtgttggagcgccggaggctagtgggtggctgacccccagcatcctcgggagcgaccatggactccctggccgagtctcggtggcctccgggcctggcagtcatgaagacaatagatgatttgctgcggtgtggaatttgcttcgagtatttcaacattgcaatgataatacctcagtgttcacataactactgctctctctgtataagaaaatttctgtcctataaaactcagtgtccaacttgctgtgtgactgtcacagagccggatctgaaaaataaccgcatattagatgaactggaatcatctgctgcagtttgctttagagtcaccagccaaatctcctgcttcttcctcttcaaagaatcttgctgtcaaagtatatactcctgtagcctccagacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgtt

SEQ ID NO: 173491 - DNA, 1550 bp, Homo sapiens
  Payload ID: 14083
  Gene Symbol: RAD18
  Gene Name: RAD18 E3 ubiquitin protein ligase
  ENST ID: ENST00000415439
  CDS Start-End: 47-979
ccggaggctagtgggtggctgacccccagcatcctcgggagcgaccatggactccctggccgagtctcggtggcctccgggcctggcagtcatgaagacaatagatgatttgctgcggtgtggaatttgcttcgagtatttcaacattgcaatgataatacctcagtgttcacataactactgctctctctgtataagaaaatttctgtcctataaaactcagtgtccaacttgctgtgtgactgtcacagagccggatctgaaaaataaccgcatattagatgaactggtaaaaagcttgaattttgcacggaatcatctgctgcagtttgctttagagtcaccagccaaatctcctgcttcttcctcttcaaagaatcttgctgtcaaagtatatactcctgtagcctccagacagtctttaaagcaggggagcaggttaatggataatttcttgatcagagaaatgagtggttctacatcagagttgttgataaaagaaaataaaagcaaattcagccctcaaaaagaggcgagccctgctgcaaagaccaaagagacacgttctgtagaagagatcgctccagatccctcagaggctaagcgtcctgagccaccctcgacatccactttgaaacaagttactaaagtggattgtcctgtttgcggggttaacattccagaaagtcacattaataagcatttagacagctgtttatcacgcgaagagaagaaggaaagcctcagaagttctgttcacaaaaggaagccgctgcccaaaactgtatataatttgctctctgatcgtgatttaaagaaaaagctaaaagagcatggattatctattcaaggaaataaacaacagctcattaaaaggcaccaagaatttgtacacatgtacaatgcccaatgcgatgctttgcatcctaaatcaggtaatggtttttacaaaggaccaaacagaaaaggaaatagatgaaatccacagtaaatatcgtaaaaaacataagagtgaatttcagcttctggtggatcaggctagaaaaggatacaagaaaattgctggaatgtcacaaaaaacagtaacaataacaaaagaagatgaatctacagaaaagctatcttctgtatgcatgggacaggaagataatatgacctcagtaacaaaccacttttctcaatcaaagctggactccccagaggaattggaacctgacagagaagaggattcttctagctgtattgatattcaagaagttctttcttcatcagaatcagattcatgcaatagttccagttcagacatcataagagatcttttagaagaagaggaagcctgggaagcatcacataaaaacgatcttcaagacacagaaataagtccaagacagaatcgccgcacaagagccgctgaaagtgctgagattgaaccaagaaacaagcgtaataggaattaatgtgggcttttgctgacttttcaaatgcattgattagaataccgtacttttggttgccacagatagattttctatttataaatgcccaaggaa

SEQ ID NO: 173492 - DNA, 557 bp, Homo sapiens
  Payload ID: 14083
  Gene Symbol: RAD18
  Gene Name: RAD18 E3 ubiquitin protein ligase
  ENST ID: ENST00000427329
  CDS Start-End: 1-394
tgctggaatgtcacaaaaaacagtaacaataacaaaagaagatgaatctacagaaaagctatcttctgtatgcatgggacaggaagataatatgacctcagtaacaaaccacttttctcaatcaaagctggactccccagaggaattggaacctgacagagaagaggattcttctagctgtattgatattcaagaagttctttcttcatcagaatcagattcatgcaatagttccagttcagacatcataagagatcttttagaagaagaggaagcctgggaagcatcacataagctctacttctccaaaagacgttacatattccaaggatcctgcgtctcaacaaaccctttcttctgcaaaagaacagcctgcttttattccaagctctgagattccttataggaagctgtttctctccagttatgccatgttatgccttaacctgggccaacagtgcctacacacggagaatgcaatggttgaggccaattcattaacagggattgtttagccacatccgttgttaattgacaacatgtctatggaattagaa

SEQ ID NO: 173493 - DNA, 581 bp, Homo sapiens
  Payload ID: 14083
  Gene Symbol: RAD18
  Gene Name: RAD18 E3 ubiquitin protein ligase
  ENST ID: ENST00000413832
  CDS Start-End: 307-581
taaaaacttctgttcagagcaaggacggatagtcactgcgattagggtgggcgacccggaggggggtcatgagcctggaccttgacagatctggtgaggtaagtgcggcagaagcctggcgcatgcgcagtacaagcccttaagcggcgccccgcccacatactactacaacttccggcaggctccgcgcccgcctctggcgcgtcgcgggctgctgacgtaatgcggtagcgcggggaatttcgagtggtgttggagcgccggaggctagtgggtggctgacccccagcatcctcgggagcgaccatggactccctggccgagtctcggtggcctccgggcctggcagtcatgaagacaatagatgatttgctgcggtgtggaatttgcttcgagtatttcaacattgcaatgataatacctcagtgttcacataactactgctctctctgtataagaaaatttctgtcctataaaactcagtgtccaacttgctgtgtgactgtcacagagccggatctgaaaaataaccgcatattagatgaactggtaaaaagcttgaattttgcacggaatcatct

SEQ ID NO: 173494 - DNA, 3749 bp, Homo sapiens
  Payload ID: 14084
  Gene Symbol: RAD21
  Gene Name: RAD21 cohesin complex component
  Uniprot ID: O60216
  ENST ID: ENST00000297338
  CDS Start-End: 289-2184
aggcgcacaggtaccattttgaccgtaaacatcctgccgatttgaaccgaggatttgggcggcaggaagagccgcggcgtaacggcagccatcttgtttgtttgagtgaatcggaaaggaggcgccggctgtggcggcggcgggagctgctcggaagctacacctcgcaagggctcccccctttccccaccccctcccccgacccttttcccctccccgggccacccagcccgcccaactcccagcggagagcaaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaatattagatgacaaacttattagtaataatgatggcggtatctttgatgatccccctgccctctctgaggcaggggtgatgttgccagagcagcctgcacatgacgatatggatgaggatgataatgtatcaatgggtgggcctgatagtcctgattcagtggatcccgttgaaccaatgccaaccatgactgatcaaacaacacttgttccaaatgaggaagaagcatttgcattggagcctattgatataactgttaaagaaacaaaagccaagaggaagaggaagctaattgttgacagtgtcaaagagttggatagcaagacaattagagcccaacttagtgattattcagatattgttactactttggatctggcaccgcccaccaagaaattgatgatgtggaaagagacaggaggagtagaaaaactgttttctttacctgctcagcctttgtggaataacagactactgaagctctttacacgctgtcttacaccgcttgtaccagaagaccttagaaaaaggaggaaaggaggagaggcagataatttggatgaattcctcaaagaatttgaaaatccagaggttcctagagaggaccagcaacagcagcatcagcagcgtgatgttatcgatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagctacaaaaagataggactgacctggtttaaagtgttctattttgtaaatcattccatttgagtctttctgatgaacttggctatactgaaatctgttattttagtgaggctccaaaatgagcaaagctaggcctgattagagtagagtgactattaaaaaacataactttctaggagctataaatcaaagttttaaaaagatgtttggatatatttgagtattccgatcatgaaaacagaaattgccctgcctactacaaggacagactgatgggaaattatgcacctggtcaacttagcttttaagcagacgatgctgtaaaaactaacggcttctctgatatttattgtaagttttagtactgatctccttttccagtgctgcacactcctggtttggaactttaatagcgttgcaacgaaatcctatatccagtttcctgtaatttaattgaagaaaaatacatccaaataaagactttattattaacagaccagatagcatcagaaatcatgtgactgttatgattatcagaatgtcttaactttttagggcaaagttaacactgaaagttctagcttaagtgttgaaacttttgtgggaaaaaaaaatcacttttgaaactcagacttcagtgtatacccaataatttaaaattatgtgaaatgttttaaatttgtgaactcgtaattactgttttaatgattcagtttcttcagagtggtaattgtataaaattgctattgcagctttacattcaatatgatgtgcctgtaaaccaaggagttttccccgtttgtaaaaagacattgtagataattgaatgtttgattttagaaaggtcattagtttcttgttacacattttgttagtctggtttttgttgcttatcgggtttaatattgttcttgaaaatagttgatgctatgttatgtataacttttctaataaaagttgtgttataagctgt

SEQ ID NO: 173495 - DNA, 874 bp, Homo sapiens
  Payload ID: 14084
  Gene Symbol: RAD21
  Gene Name: RAD21 cohesin complex component
  ENST ID: ENST00000517485
  CDS Start-End: 199-874
actcctgggggcgggagggcgagggagaaggcagccctcgccgcgcccacgcgtgctgccaccctcccggcgcccaagcggcggcgccacccgcccagcccccttcgccccgggcccgccctcggcccggacccatgcagcttgggcccgcatcatcgcttgttcggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatg

SEQ ID NO: 173496 - DNA, 896 bp, Homo sapiens
  Payload ID: 14084
  Gene Symbol: RAD21
  Gene Name: RAD21 cohesin complex component
  ENST ID: ENST00000518055
  CDS Start-End: 200-730
tgagtaaatctttatggagctaaaattttatctggccttcttcattaaagaaagcattatgtatgtcttagtgtactagtttaaaaaataaatggttctataatactgttcaaaactgtatgacctatgttttctcttcatatgaccaattgcagatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttca

SEQ ID NO: 173497 - DNA, 548 bp, Homo sapiens
  Payload ID: 14084
  Gene Symbol: RAD21
  Gene Name: RAD21 cohesin complex component
  ENST ID: ENST00000522699
  CDS Start-End: 188-548
aacaaatgattctgatccattctgagatctacaaaggctgttaccctgcaggtccatctcacgtcccccaggaggccggggaaaccctgggctgcggagggaggggaggaggtttgaacgagcccgctctggggaccgggccgcctactccgcgggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccac

SEQ ID NO: 173498 - DNA, 2506 bp, Homo sapiens
  Payload ID: 14084
  Gene Symbol: RAD21
  Gene Name: RAD21 cohesin complex component
  ENST ID: ENST00000523986
  CDS Start-End: 1504-1911
ttgagtaaatctttatggagctaaaattttatctggccttcttcattaaagaaagcattatgtatgtcttagtgtactagtttaaaaaataaatggttctataatactgttcaaaactgtatgacctatgttttctcttcatatgaccaattgcagatgagcccattattgaagagccaagccgcctccaggagtcagtgatggaggccagcagaacaaacatagatgagtcagctatgcctccaccaccacctcagggagttaagcgaaaagctggacaaattgacccagagcctgtgatgcctgtaagtaagcaaatctatccattaagtcatttgaaggtattcatacagtcagtagcaagtggtatttagggaggccttttaaagtatcttggttttgacagaaaatggtaaggaatgagtccagaggaagaagagcaacaggatatagacagtccactcggagtgagagaatatgttctgggagtcggtgcagtctttcctgactctttttgaatagtattgctttagagtgctccagagtgagcatccttgactctgaagttggttctgatttattatttggcaaacattcctgcacaccttcagtactaggcagttttaggtcatcttattaagtaatcagaataaacttcaaatacctgagaaaatgtaaagcagtatctgtctgcttcattcaaactttgactaccattgagttcagctaggataggaaagctaagcaagtatgaaggaggaaatagtagggtttggtttagggctttccaatcttaagtccatagaataaatgaatttgtgcaaagggaggcttttagataaccttaggcttcttgttcagcctccatcaagaatactctgccaattttaagaactagttttctgtgccctctggtggtaagagttgtcaataagagcatttttctgtatgagctcaggaataggaacacagtaatgagtaggtgactttcataaccaccctccttctggtaattctttagtttcttttaaagactttggttttaatgttcttaactctttctgtaaagcctgagagaagatataggaagtggacccagaaaagcaatgtcctcactcctattatttgctgccgtgagacattcaagactctcagagagaaagcttatgatttataagttacaatataataaccttacagaagctttagtagttaaaaagcatttgactcctaaaaagtaagtatgaaaatgaaacatggtttaggataagcagtcagtttcttttgtaagctacttcaatgtagttttataaaaaatcaaaaaagatatatactgtaataaatttttccttgtggggaagtatagagatataatctcagtatttctttttgactagaaaacttcagccactgtgtattttcatatttaaaataagctactttaaaagcatatatcttaaattgtcttatttgtattgctttaagcctcagcaggtagagcagatggaaataccacctgtagagcttcccccagaagaacctccaaatatctgtcagctaataccagagttagaacttctgccagaaaaagagaaggagaaagagaaggaaaaagaagatgatgaagaggaagaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaatattggtgcatgtaataatgttgagtggcagtcaaaagtcatgatttttatcttagttcttcattactgcattgaaaaggaaaacctgtctgagaaaatgcctgacagtttaatttaaaactatggtgtaagtctttgacaagaaaaaaaaacaaacaaacacttctttccatcagtaacactggcaatcttcctgttaaccactctccttagggatggtatctgaaacaacaatggtcaccctcttgagattcgttttaagtgtaattccataatgagcagaggtgtacgcgaaattgtgttatgactgatagccttcagc

SEQ ID NO: 173499 - DNA, 831 bp, Homo sapiens
  Payload ID: 14084
  Gene Symbol: RAD21
  Gene Name: RAD21 cohesin complex component
  ENST ID: ENST00000520992
  CDS Start-End: 148-831
tcgccccgggcccgccctcggcccggacccatgcagcttgggcccgcatcatcgcttgttcggtaacaaatgattctgatccattctgagatctacaaaggctgttaccctgcaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgacttagatgacatcgatgtggcccagcagttcagcttgaatcagagtagagtggaagagataaccatgagagaagaagttgggaacatcagtattttacaagaaaatgattttggtgattttggaatggatgatcgtgagataatgagagaaggcagtgcttttgaggatgacgacatgttagtaagcactactacttctaacctcctattagagtctgaacagagcaccagcaatctgaatgagaaaattaaccatttagaatatgaagatcaatataaggatgataattttggagaaggaaatgatggtggaata

SEQ ID NO: 173500 - DNA, 1003 bp, Homo sapiens
  Payload ID: 14084
  Gene Symbol: RAD21
  Gene Name: RAD21 cohesin complex component
  ENST ID: ENST00000517749
  CDS Start-End: 521-730
attaagagtctgccagaacattagtcatctagaaaatcatgttgcaatatttatgtatgtatatttagttgaaataaacagtatatttagtggtacagttgatttatatcctgaagttctttaagaggggccagtaaccaaaacctccatgatcagcagcagtccacagaccacatagtgtgtgtagatagcatccttatagcgcaatatagaagcatactttcagccaaatgtttgcttgcacatagaggactttgccttgtaatttaagaaaaacagactcttcagtttgtactctaaatgctaagtgattgctcagcagcattaagtacagttttctattagttcaaaatacacaatctcaaggtaatttaggagcttttaggagatgtagaaatacttcatttttcattggacttgttttgtcagctttttgggggtcatttttattcaggatgaagatgcatcagggggcgatcaagatcaggaagaaagaagatggaacaaaaggactcagcagatgcttcatggtcttcagcgtgctcttgctaaaactggagctgaatctatcagtttgcttgagttatgtcgaaatacgaacagaaaacaagctgccgcaaagttctacagcttcttggttcttaaaaagcagcaagctattgagctgacacaggaagaaccgtacagtgacatcatcgcaacacctggaccaaggttccatattatataaggagctagaagcattatagctagtgtttgattcactagtgcttacaaattgcccccatgtgtaggggacacagaaccctttgagaaaacttagatttttgtctgtacaaagtctttgcctttttccttcttcatttttttccagtacattaaatttgtcaatttcatctttgagggaaactgattagatgggttgtgtttgtgttctgatggagaaaacagcaccccaaggactcagaagatgattttaacagttcagaacagatgtgtgcaa

SEQ ID NO: 173501 - DNA, 515 bp, Homo sapiens
  Payload ID: 14084
  Gene Symbol: RAD21
  Gene Name: RAD21 cohesin complex component
  ENST ID: ENST00000519837
  CDS Start-End: 144-515
aacaaatgattctgatccattctgagatctacaaaggctgttaccctgcaggtccatctcacgtcccccaggaggccggggaaaccctgggctgcggagggaggggaggaggttttcttctgttttcatagccagccagaacaatgttctacgcacattttgttctcagtaaaagagggcctctggccaaaatttggctagcggcccattgggataagaagctaaccaaagcccatgtgttcgagtgtaatttagagagcagcgtggagagtatcatctcaccaaaggtgaaaatggcattacggacatcaggacatctcttactgggagtagttcgaatctatcacaggaaagccaaataccttcttgcagactgtaatgaagcattcattaagataaagatggcttttcggccaggtgtggttgacctgcctgaggaaaatcgggaagcagcttataatgccattactttacctgaagaatttcatgactttgatcagccactgcctgactta

SEQ ID NO: 173502 - DNA, 492 bp, Homo sapiens
  Payload ID: 14085
  Gene Symbol: RAD21L1
  Gene Name: RAD21 cohesin complex component like 1
  ENST ID: ENST00000246108
  CDS Start-End: 297-492
ttgaaagtagggcgcagcctgagaggccggccggaccccgagtgctgtaggcgggctgggagatgggggccgccgccacccacattcccacacgcacccggcgccggcgcctcacgccgtgttagctcgcggcgccaagcccggagggtcccgcctgaggaagaaaggtcgtcgcccgcagcccagctggggctggaggcgcgacccggggtctcctcgcccgcacgcggaagaaaatgggcgctgtggcctcagtttccctcttttgttaaatacaagtaaggaacacaggcaacatgttctacacacatgtgcttatgagtaaacgagggccattggccaaaatatggcttgcagctcactgggagaagaaactcacaaaggcccatgtatttgaatgtaatctagagataaccattgaaaaaattctttcacccaaggtgaaaatagcacttcgaacttcaggacaccttcttttgggagttgttcgaa

SEQ ID NO: 173503 - DNA, 1707 bp, Homo sapiens
  Payload ID: 14085
  Gene Symbol: RAD21L1
  Gene Name: RAD21 cohesin complex component like 1
  Uniprot ID: Q9H4I0
  ENST ID: ENST00000402452
  CDS Start-End: 118-1683
cggcgccaagaacccggccaagctgacttggcgactcctcgcagcccctgctctggcacgccacacctcagacgaggctttgaaatttgttaaatacaagtaaggaacacaggcaacatgttctacacacatgtgcttatgagtaaacgagggccattggccaaaatatggcttgcagctcactgggagaagaaactcacaaaggcccatgtatttgaatgtaatctagagataaccattgaaaaaattctttcacccaaggtgaaaatagcacttcgaacttcaggacaccttcttttgggagttgttcgaatctataacaggaaggcaaaatatcttttggcagattgcagtgaagcatttcttaaaatgaagatgacattttgcccaggactggttgaccttccaaaagagaattttgaagcatcttacaatgctatcacattgccagaagaatttcatgattttgacacccaaaatatgaatgctattgatgtttcagaacactttactcagaaccaaagcagaccagaagaaatcactcttagagaaaattttgacaatgatctaattttccaagctgagagctttggggaggaatctgaaattctcagaagacatagcttctttgatgacaacatattactgaattccagtggtcctttaattgaacatagttctggaagcctcactggagaacgatctctattctatgacagtggagatgggtttggagatgaaggagctgcaggagaaatgattgacaatctattgcaagatgatcagaatatcctgttagaagacatgcatttgaacagagaaatttccctgccttctgagcctcccaatagtttagcagttgaaccagataactcagagtgtatatgtgtacctgaaaatgaaaaaatgaatgaaacaatattattatcaactgaagaggaaggatttacccttgatccaattgatatttcagacattgctgagaaaaggaaaggcaaaaagaggagattgctcatagatcctatcaaggagctcagtagcaaagttatacataaacagcttacttcctttgcggacacactcatggttttggaacttgcacctcctacccaaagattgatgatgtggaagaagaggggaggagtgcatacacttctgtcaactgctgcccaggatttgattcatgctgaactgaaaatgttgtttacaaaatgctttctgtcctctggctttaaacttggaagaaaaatgatacagaaggagtcagtaagggaagaagtgggaaaccaaaatatagtagagacatccatgatgcaagagccaaattaccagcaagagttaagtaaaccccaaacttggaaggatgtgattggtggatctcagcatagctctcatgaggataccaataaaaatattaactctgaggagtcattgagcaatgaagaaaatattgagacagagagatggaatggaagaatacttcagatgttaaatcgtttacgggtcgctgatcagggccaggcggctgcagcagcgactgcagaggcgctgcgccaagccgggccggagtggtgcgagccggcggggctgcggagggccagtggactcagcccccgggataccgcccatcccaccccttactcggacccacagcctcatggccatgtccctgccaggaagtagacggacctctgctggatcacgcag

SEQ ID NO: 173504 - DNA, 1808 bp, Homo sapiens
  Payload ID: 14085
  Gene Symbol: RAD21L1
  Gene Name: RAD21 cohesin complex component like 1
  Uniprot ID: Q9H4I0
  ENST ID: ENST00000409241
  CDS Start-End: 94-1764
acctcagacgaggctttgaaagtagggcgcagcctgagaggccggccggaccccgagtgcttttgttaaatacaagtaaggaacacaggcaacatgttctacacacatgtgcttatgagtaaacgagggccattggccaaaatatggcttgcagctcactgggagaagaaactcacaaaggcccatgtatttgaatgtaatctagagataaccattgaaaaaattctttcacccaaggtgaaaatagcacttcgaacttcaggacaccttcttttgggagttgttcgaatctataacaggaaggcaaaatatcttttggcagattgcagtgaagcatttcttaaaatgaagatgacattttgcccaggactggttgaccttccaaaagagaattttgaagcatcttacaatgctatcacattgccagaagaatttcatgattttgacacccaaaatatgaatgctattgatgtttcagaacactttactcagaaccaaagcagaccagaagaaatcactcttagagaaaattttgacaatgatctaattttccaagctgagagctttggggaggaatctgaaattctcagaagacatagcttctttgatgacaacatattactgaattccagtggtcctttaattgaacatagttctggaagcctcactggagaacgatctctattctatgacagtggagatgggtttggagatgaaggagctgcaggagaaatgattgacaatctattgcaagatgatcagaatatcctgttagaagacatgcatttgaacagagaaatttccctgccttctgagcctcccaatagtttagcagttgaaccagataactcagagtgtatatgtgtacctgaaaatgaaaaaatgaatgaaacaatattattatcaactgaagaggaaggatttacccttgatccaattgatatttcagacattgctgagaaaaggaaaggcaaaaagaggagattgctcatagatcctatcaaggagctcagtagcaaagttatacataaacagcttacttcctttgcggacacactcatggttttggaacttgcacctcctacccaaagattgatgatgtggaagaagaggggaggagtgcatacacttctgtcaactgctgcccaggatttgattcatgctgaactgaaaatgttgtttacaaaatgctttctgtcctctggctttaaacttggaagaaaaatgatacagaaggagtcagtaagggaagaagtgggaaaccaaaatatagtagagacatccatgatgcaagagccaaattaccagcaagagttaagtaaaccccaaacttggaaggatgtgattggtggatctcagcatagctctcatgaggataccaataaaaatattaactctgagcaggatattgttgaaatggtgtctttagctgctgaggaatcatctttaatgaatgacttatttgcacaagaaattgaatatagtccagttgaattggagtcattgagcaatgaagaaaatattgagacagagagatggaatggaagaatacttcagatgttaaatcgtttacgggaatctaacaagatgggaatgcagtcctttagtctgatgaagctctgtagaaatagtgaccgaaaacaagcagctgccaaattttatagctttcttgtcctaaagaaacagctggctattgagctgagccagagtgctccctatgcagatattatagctacgatgggaccaatgttttataacatatgaaggaaacccagacatacagatttatggcatcactggaatttctg

SEQ ID NO: 173505 - DNA, 1736 bp, Homo sapiens
  Payload ID: 14086
  Gene Symbol: RAD23A
  Gene Name: RAD23 homolog A, nucleotide excision repair protein
  Uniprot ID: P54725
  ENST ID: ENST00000316856
  CDS Start-End: 74-1162
cgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtg

SEQ ID NO: 173506 - DNA, 894 bp, Homo sapiens
  Payload ID: 14086
  Gene Symbol: RAD23A
  Gene Name: RAD23 homolog A, nucleotide excision repair protein
  ENST ID: ENST00000586375
  CDS Start-End: 1-188
cgggctctgagtatgagacgatgctgacggagatcatgtccatgggctatgagcgagagcgggtcgtggccgccctgagagccagctacaacaacccccaccgagccgtggagtatctgctcacgcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccc

SEQ ID NO: 173507 - DNA, 1350 bp, Homo sapiens
  Payload ID: 14086
  Gene Symbol: RAD23A
  Gene Name: RAD23 homolog A, nucleotide excision repair protein
  ENST ID: ENST00000591499
  CDS Start-End: 95-523
gcgcggcgcggcgcgcctgggcgctaagatggcggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcc

SEQ ID NO: 173508 - DNA, 1691 bp, Homo sapiens
  Payload ID: 14086
  Gene Symbol: RAD23A
  Gene Name: RAD23 homolog A, nucleotide excision repair protein
  ENST ID: ENST00000593114
  CDS Start-End: 56-475
gtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcagggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaagg

SEQ ID NO: 173509 - DNA, 1746 bp, Homo sapiens
  Payload ID: 14086
  Gene Symbol: RAD23A
  Gene Name: RAD23 homolog A, nucleotide excision repair protein
  Uniprot ID: P54725
  ENST ID: ENST00000586534
  CDS Start-End: 62-1153
ggcggcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccaggtgacgccgcaggagaaagaagctatagagaggttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaaccgtgtctctgataaaggttttgaagtgaataaagttttaaaaacta

SEQ ID NO: 173510 - DNA, 999 bp, Homo sapiens
  Payload ID: 14086
  Gene Symbol: RAD23A
  Gene Name: RAD23 homolog A, nucleotide excision repair protein
  ENST ID: ENST00000590881
  CDS Start-End: 1-453
attcctgggagccccgagccggaacacggttctgtccaggagagccaggtatcggagcagccggccacggaagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccagatgctgaacgagccccctggggagctggcggacatctcagatgtggagggggaggtgggcgccataggagaggaggccccgcagatgaactacatccagttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaacagaa

SEQ ID NO: 173511 - DNA, 1526 bp, Homo sapiens
  Payload ID: 14086
  Gene Symbol: RAD23A
  Gene Name: RAD23 homolog A, nucleotide excision repair protein
  Uniprot ID: P54725
  ENST ID: ENST00000592268
  CDS Start-End: 58-984
gcgtgagttgcatgttgtgtgaggatcccggggccgccgcgtcgctcgggccccgccatggccgtcaccatcacgctcaaaacgctgcagcagcagaccttcaagatccgcatggagcctgacgagacggtgaaggtgctaaaggagaagatagaagctgagaagggtcgtgatgccttccccgtggctggacagaaactcatctatgccggcaagatcttgagtgacgatgtccctatcagggactatcgcatcgatgagaagaactttgtggtcgtcatggtgaccaagaccaaagccggccagggtacctcagcacccccagaggcctcacccacagctgccccagagtcctctacatccttcccgcctgcccccacctcaggcatgtcccatcccccacctgccgccagagaggacaagagcccatcagaggaatccgcccccacgacgtccccagagtctgtgtcaggctctgttccctcttcaggtagcagcgggcgagaggaagacgcggcctccacgctagtgacgggctctgagtatgagacgatgctgacggagatcatgtccatgggctatgagcgagagcgggtcgtggccgccctgagagccagctacaacaacccccaccgagccgtggagtatctgctcacgggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagttgaaggccctgggcttcccagagagcctggtcatccaggcctatttcgcgtgtgaaaaaaatgagaacttggctgccaacttcctcctgagtcagaactttgatgacgagtgatgccaggaagccaggccaccgaagcccccaccctacccttattccatgaaagttttataaaagaaaaaatatatatatattcatgtttatttaagaaatggaaaaaaaaatcaaaaatcttaaaaaaacaagcaaacagtccagcttcctgtcctcctaaagtggcccctgttcccatctcccgggccagacagctgtccccccgtcctcctccccagcccagcctgctcagagaagctggcaggactgggaggcgacagatgggcccctcttggcctctgtcccagctctctgcagccagacggaaaggcggctgcttgcctctccatcctccgaaaaacccctgaggacccccccccatcctcttctaggatgaggggaagctggagccccaactttgatcctccattggagtggcccaaatctttccatctagggcaagtcctgaaaggcccaaggccccctccccagtctggccttggcctccagcctggagaagggctaacatcagctcattgtcaaggccacccccaccccagaac

SEQ ID NO: 173512 - DNA, 4119 bp, Homo sapiens
  Payload ID: 14087
  Gene Symbol: RAD23B
  Gene Name: RAD23 homolog B, nucleotide excision repair protein
  Uniprot ID: P54727
  ENST ID: ENST00000358015
  CDS Start-End: 352-1581
gagtcacgatgatggcggccaccatcctgtggtgagctagcggattccctgcttgtctcgccgaccccctcgcgccttctgcagactccgtggctggcgctcggcgcgtgaggaagcacggcggcccgagttcgcggggaaggccgcagtcgcggaggcagcggcgcggtccggggcacgggctgggggagaggccgctccgctgggcgaatgtgacaagcccccacccccaccgccttcctccccagagcgcgaggagcgcgggcgaccccggggccccgccaggccacagaccccgcccagcggccagcacccggcgcaggcccggcagccgagctgcgcggcggcaccatgcaggtcaccctgaagaccctccagcagcagaccttcaagatagacattgaccccgaggagacggtgaaagcactgaaagagaagattgaatctgaaaaggggaaagatgcctttccagtagcaggtcaaaaattaatttatgcaggcaaaatcctcaatgatgatactgctctcaaagaatataaaattgatgagaaaaactttgtggtggttatggtgaccaaacccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaagcctgcagaaaagccagcagagacaccagtggctactagcccaacagcaactgacagtacatcgggtgattcttctcggtcaaacctttttgaagatgcaacgagtgcacttgtgacgggtcagtcttacgagaatatggtaactgagatcatgtcaatgggctatgaacgagagcaagtaattgcagccctgagagccagtttcaacaaccctgacagagcagtggagtatcttttaatgggaatccctggagatagagaaagtcaggctgtggttgacccccctcaagcagctagtactggggctcctcagtcttcagcagtggctgcagctgcagcaactacgacagcaacaactacaacaacaagttctggaggacatccccttgaatttttacggaatcagcctcagtttcaacagatgagacaaattattcagcagaatccttccttgcttccagcgttactacagcagataggtcgagagaatcctcaattacttcagcaaattagccaacaccaggagcattttattcagatgttaaatgaaccagttcaagaagctggtggtcaaggaggaggaggtggaggtggcagtggaggaattgcagaagctggaagtggtcatatgaactacattcaagtaacacctcaggaaaaagaagctatagaaaggttaaaggcattaggatttcctgaaggacttgtgatacaagcgtattttgcttgtgagaagaatgagaatttggctgccaattttcttctacagcagaactttgatgaagattgaaagggacttttttatatctcacacttcacaccagtgcattacactaacttgttcactggattgtctgggatgacttgggctcatatccacaatacttggtataaggtagtagattgttgggggtggggagggagggatctaggatacagggcagggataaatacagtgcatgtctgcttcaattagcagatgccgcaactccacacagtgtgtaaaatatatacaaccaaaaatcagcttttgcaggtctttatttcttctgtaaaacagtaggtaacttttcctaggtttcactctttttagtgtactagatccagaaacttagtgtaatgccctgctttatatttctttgacttaacattggtttcagaaagaatcttagctacctagaatttacagtctctgtttcatggcaacactggataatggctttgtgaaatttaaaaaatttttgtagcgactgtaaacagaaatgccaaattgatggttaattgttgctgcttcaaaaataagtataaaattaatatgtaaggaagcccattctttcatgttaaatacttggggtgggaggggagaaagggaaccttttcttaaaatgaaaataattactgctattttaaaatttcttgatcattgaatgtgagacccttctaacatgatttgagaagctgtacaagtataggcagagttattttcctgtttacattttttttttgttttggggaaaaaattggtaggtgtctaattactgtttacttcattgttatattgcagtaaaagttttaaaacaaccattgcatgtttgcttttgatgtatccctttgtgaaattagcacttttggggccaatggagaaatgcagcattcactctccctgtcttttccccttccctcagcagaaacgtgtttatcagcaagtcgtgagtcaaactgctgccttttaaaaaacccacaaaatgctgattcagttcaaaattaatgcaaatgtttcaaaactgggtttctgatatttgtaaatgtgtttctttattagataagagtgtattaccattaaagtcattagtataatattgctttcaaaaagaaatggtagacaaaactataatccagcatcttttattgcattggaaagactggcaaagtcttttggatgggttgggagatgtggctggaaagtactttggaaaatatacaatcaagatatctcatggcatattaaaagaaaaatcttaatagcagtgttggcttttatttggattttttcatctcagttttttctgtggaatctccttcattggcattgttatttaatcataaacggggcagatgtctacttgttcagtttttcaaatctgttttcctgagtataaataagagtatttaaagaaataatttggattgcttttgttttttgtttccttttttttaaccatctgatactaagaagatgaatttgcacagatttctctgcataatttctcaatatctttagcacagtatggtgatgatgacttttaagcatttacatcacgtactcataacctattatgaaaataaatgaaactggctgggtatggtggctcatgcctataatcccagcactttgggaggccgaggtgggcagatcacttgaggccaggagattgagaccagcctgaccgtcatggcgaaaccccgtctatactaaaaatacaaaaaatagccaggcatggtggcgcacgcctgtggtcccagctacttgggaggctgaggcatgagaattgcttgaacccgggaagtgaaggttgccgtgagctgagatcacaccactgccataaacatgacaggcttttggactttgtattacctgtatgttttataatggatcatgcataatttctcaggagaataaaatgagaattcatatatacgttcatctttcaagtcagagcaatgagttgggaaaagaggtggcatttctgatcggataatggaatactctcatttattttatgacattctctgtctactcagatcatagtgaaaactggaaacaaaaaaaaaaaacagcctcttcttggaaagtgacagcagaaggtggcatggagcttgtgtccttggacaacaaatctggatatactaggattaattatcagaagacagctcaggccaagttttgatcgttccatacagtaccttgtttatctgcttcttaaagaatcagccgagacaccataaaagaaataggctttttgtgccttttgctgttaatgtttaatttacaaactgttttggtaaatctcttaatgtaagtagctatttgactttggaattttgcattcgaggtatactgtcatttcttgaaatctttttctcgtttagttgctctgtgggaaatgtgaggaagcctaagtttgtatttgtaaatttcttatgccatcctctagtcaaattttttttcattgtttaaaaatacggaagtgttccaatataattttttcctgtactggatggctaggattctagagaattgattataaaatattttcaatacatccaa

SEQ ID NO: 173513 - DNA, 811 bp, Homo sapiens
  Payload ID: 14087
  Gene Symbol: RAD23B
  Gene Name: RAD23 homolog B, nucleotide excision repair protein
  ENST ID: ENST00000457811
  CDS Start-End: 1-344
cgacagcatcttctgaacctgcacctgctagtgcagctaaacaagagaagcctgcagaaaagccagcagagacaccagtggctactagcccaacagcaactgacagtacatcgggtgattcttctcggtcaaacctttttgaagatgcaacgagtgcacttgtgacgggtcagtcttacgagaatatggtaactgagatcatgtcaatgggctatgaacgagagcaagtaattgcagccctgagagccagtttcaacaaccctgacagagcagtggagtatcttttaatgatcatagtgaaaactggaaacaaaaaaaaaaaacagcctcttcttggaaagtgacagcagaaggtggcatggagcttgtgtccttggacaacaaatctggatatactaggattaattatcagaagacagctcaggccaagttttgatcgttccatacagtaccttgtttatctgcttcttaaagaatcagccgagacaccataaaagaaataggctttttgtgccttttgctgttaatgtttaatttacaaactgttttggtaaatctcttaatgtaagtagctatttgactttggaattttgcattcgaggtatactgtcatttcttgaaatctttttctcgtttagttgctctgtgggaaatgtgaggaagcctaagtttgtatttgtaaatttcttatgccatcctctagtcaaattttttttcattgtttaaaaatacggaagtgttccaatataattttttcctgtactggatggctaggattctagagaattgattataaaatattttcaataca

SEQ ID NO: 173514 - DNA, 3835 bp, Homo sapiens
  Payload ID: 14087
  Gene Symbol: RAD23B
  Gene Name: RAD23 homolog B, nucleotide excision repair protein
  Uniprot ID: P54727
  ENST ID: ENST00000416373
  CDS Start-End: 286-1299
ggtgggggagggagacgtaggcgtcgccactacccctgtgtggacctggttagccgcttagttcccagagttggtaacccgagaagatgagccttaagaaaaaaaaaagtatcaggttccgtttgccgccgagaggtgaaagcactgaaagagaagattgaatctgaaaaggggaaagatgcctttccagtagcaggtcaaaaattaatttatgcaggcaaaatcctcaatgatgatactgctctcaaagaatataaaattgatgagaaaaactttgtggtggttatggtgaccaaacccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaagcctgcagaaaagccagcagagacaccagtggctactagcccaacagcaactgacagtacatcgggtgattcttctcggtcaaacctttttgaagatgcaacgagtgcacttgtgacgggtcagtcttacgagaatatggtaactgagatcatgtcaatgggctatgaacgagagcaagtaattgcagccctgagagccagtttcaacaaccctgacagagcagtggagtatcttttaatgggaatccctggagatagagaaagtcaggctgtggttgacccccctcaagcagctagtactggggctcctcagtcttcagcagtggctgcagctgcagcaactacgacagcaacaactacaacaacaagttctggaggacatccccttgaatttttacggaatcagcctcagtttcaacagatgagacaaattattcagcagaatccttccttgcttccagcgttactacagcagataggtcgagagaatcctcaattacttcagcaaattagccaacaccaggagcattttattcagatgttaaatgaaccagttcaagaagctggtggtcaaggaggaggaggtggaggtggcagtggaggaattgcagaagctggaagtggtcatatgaactacattcaagtaacacctcaggaaaaagaagctatagaaaggttaaaggcattaggatttcctgaaggacttgtgatacaagcgtattttgcttgtgagaagaatgagaatttggctgccaattttcttctacagcagaactttgatgaagattgaaagggacttttttatatctcacacttcacaccagtgcattacactaacttgttcactggattgtctgggatgacttgggctcatatccacaatacttggtataaggtagtagattgttgggggtggggagggagggatctaggatacagggcagggataaatacagtgcatgtctgcttcaattagcagatgccgcaactccacacagtgtgtaaaatatatacaaccaaaaatcagcttttgcaggtctttatttcttctgtaaaacagtaggtaacttttcctaggtttcactctttttagtgtactagatccagaaacttagtgtaatgccctgctttatatttctttgacttaacattggtttcagaaagaatcttagctacctagaatttacagtctctgtttcatggcaacactggataatggctttgtgaaatttaaaaaatttttgtagcgactgtaaacagaaatgccaaattgatggttaattgttgctgcttcaaaaataagtataaaattaatatgtaaggaagcccattctttcatgttaaatacttggggtgggaggggagaaagggaaccttttcttaaaatgaaaataattactgctattttaaaatttcttgatcattgaatgtgagacccttctaacatgatttgagaagctgtacaagtataggcagagttattttcctgtttacattttttttttgttttggggaaaaaattggtaggtgtctaattactgtttacttcattgttatattgcagtaaaagttttaaaacaaccattgcatgtttgcttttgatgtatccctttgtgaaattagcacttttggggccaatggagaaatgcagcattcactctccctgtcttttccccttccctcagcagaaacgtgtttatcagcaagtcgtgagtcaaactgctgccttttaaaaaacccacaaaatgctgattcagttcaaaattaatgcaaatgtttcaaaactgggtttctgatatttgtaaatgtgtttctttattagataagagtgtattaccattaaagtcattagtataatattgctttcaaaaagaaatggtagacaaaactataatccagcatcttttattgcattggaaagactggcaaagtcttttggatgggttgggagatgtggctggaaagtactttggaaaatatacaatcaagatatctcatggcatattaaaagaaaaatcttaatagcagtgttggcttttatttggattttttcatctcagttttttctgtggaatctccttcattggcattgttatttaatcataaacggggcagatgtctacttgttcagtttttcaaatctgttttcctgagtataaataagagtatttaaagaaataatttggattgcttttgttttttgtttccttttttttaaccatctgatactaagaagatgaatttgcacagatttctctgcataatttctcaatatctttagcacagtatggtgatgatgacttttaagcatttacatcacgtactcataacctattatgaaaataaatgaaactggctgggtatggtggctcatgcctataatcccagcactttgggaggccgaggtgggcagatcacttgaggccaggagattgagaccagcctgaccgtcatggcgaaaccccgtctatactaaaaatacaaaaaatagccaggcatggtggcgcacgcctgtggtcccagctacttgggaggctgaggcatgagaattgcttgaacccgggaagtgaaggttgccgtgagctgagatcacaccactgccataaacatgacaggcttttggactttgtattacctgtatgttttataatggatcatgcataatttctcaggagaataaaatgagaattcatatatacgttcatctttcaagtcagagcaatgagttgggaaaagaggtggcatttctgatcggataatggaatactctcatttattttatgacattctctgtctactcagatcatagtgaaaactggaaacaaaaaaaaaaaacagcctcttcttggaaagtgacagcagaaggtggcatggagcttgtgtccttggacaacaaatctggatatactaggattaattatcagaagacagctcaggccaagttttgatcgttccatacagtaccttgtttatctgcttcttaaagaatcagccgagacaccataaaagaaataggctttttgtgccttttgctgttaatgtttaatttacaaactgttttggtaaatctcttaatgtaagtagctatttgactttggaattttgcattcgaggtatactgtcatttcttgaaatctttttctcgtttagttgctctgtgggaaatgtgaggaagcctaagtttgtatttgtaaatttcttatgccatcctctagtcaaattttttttcattgtttaaaaatacggaagtgttccaatataattttttcctgtactggatggctaggattctagagaattgattataaaatattttcaatacatcc

SEQ ID NO: 173515 - DNA, 456 bp, Homo sapiens
  Payload ID: 14087
  Gene Symbol: RAD23B
  Gene Name: RAD23 homolog B, nucleotide excision repair protein
  ENST ID: ENST00000442587
  CDS Start-End: 217-456
ataatactaagtttaaaccagcagctttctgcccaactctatttttaaaagtagttgattctattttgggtggagatcaggggctttggtgttaagtagacctgagttccatttgtggttttgtaacttatttgctatgaccttgggcaaattacggttagtttcattctctgtataatagggataatacctgccttgcagagatgtgaagattagatggtgaaagcactgaaagagaagattgaatctgaaaaggggaaagatgcctttccagtagcaggtcaaaaattaatttatgcaggcaaaatcctcaatgatgatactgctctcaaagaatataaaattgatgagaaaaactttgtggtggttatggtgaccaaacccaaagcagtgtccacaccagcaccagctacaactcagcagtcagctcctgccagcactacagcagttacttcc

SEQ ID NO: 173516 - DNA, 716 bp, Homo sapiens
  Payload ID: 14087
  Gene Symbol: RAD23B
  Gene Name: RAD23 homolog B, nucleotide excision repair protein
  ENST ID: ENST00000419616
  CDS Start-End: 277-716
gccttccgccccgcccccaattctggggcggagtcctcggccgcgccggcgcaaagcgtcgccgcaccccacgcctgcgcgcttcgcccgcccggccccatccccccaggtttttcgcgtgggggagggggcacgtctcggcgagtcacgatgatggcggccaccatcctgtgagcgcgaggagcgcgggcgaccccggggccccgccaggccacagaccccgcccagcggccagcacccggcgcaggcccggcagccgagctgcgcggcggcaccatgcaggtcaccctgaagaccctccagcagcagaccttcaagatagacattgaccccgaggagacggtgaaagcactgaaagagaagattgaatctgaaaaggggaaagatgcctttccagtagcaggtcaaaaattaatttatgcaggcaaaatcctcaatgatgatactgctctcaaagaatataaaattgatgagaaaaactttgtggtggttatggtgaccaaacccaaagcagtgtccacaccagcaccagctacaactcagcagtcagctcctgccagcactacagcagttacttcctccaccaccacaactgtggctcaggctccaacccctgtccctgccttggcccccacttccacacctgcatccatcactccagcatcagcgacagcatcttctgaacctgcacctgctagtgcagctaaacaagagaa

SEQ ID NO: 173517 - DNA, 8306 bp, Homo sapiens
  Payload ID: 14088
  Gene Symbol: RAD50
  Gene Name: RAD50 homolog, double strand break repair protein
  Uniprot ID: Q92878
  ENST ID: ENST00000378823
  CDS Start-End: 388-4326
ccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtgggctccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaacattgtgtctaggattttggatgttgagaggttctaaaatcatgaaacttgtttcactgaaaattggacagattgcctgtttctgatttgctgctcttcatcccattccaggcagcctctgtcaggccttcagggttcagcagtacagccgagactcgactctgtgcctccctccccagtgcaaatgcatgcttcttctcaaagcactgttgagaaggagataattactgccttgaaaatttatggttttggtatttttttaaatcatagttaaatgttacctctgaatttacttccttgcatgtggtttgaaaaactgagtattaatatctgaggatgaccagaaatggtgagatgtatgtttggctctgcttttaactttataaatccagtgacctctctctctgggacttggtttccccaactaaaatttgaagtagttgaatggggtctcaaagtttgacaggaaccttaagtaatcatctaagtcagtacccaccaccttcttctcctacatatcccttccagatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctctctaagtgggcattgccatgtggaaggcaagccaggctcactcacagagtcaaggcctgctccctgtagggtccaaccagacctggaagaacaggcctctccatttgctcttcagatgccacttctaagaaaagcctaatcacagtttttcctggaattgccagctgacatcttgaatccttccattccacacagaatgcaaccaagtcacacgcttttgaattatgctttgtagagttttgtcattcagagtcagccaggaccataccgggtcttgattcagtcacatggcatggttttgtgccatctgtagctataatgagcatgtttgcctagacagcttttctcaactgggtccagaagagaattaagccctaaggtcctaaggcatctatctgtgctaggttaaatggttggcccccaaagatagacaggtcctgatttctagaacccgtgactgttactttatacagcaaaggaaactttgcagatgtgattaaagctaaggaccttaagacagagtatcctgggggtggtggtggggtgggggggggtcctaaatgtaatcacgagtaagattaagagcaaatcaattctagtcatatattaaacatccacaataaccaagatatttttatcccaagaatgcaagatttcagaaaatgaaaaatctgttgataaatccatcactataataaaaccgaaggtgaaaaaaattctgaaaaaattctagcagctatatttgataaaattcaacatctcctagctttagcaaactcacagttttgcaaataatattttcttaatgttatctgttgctaaatcaaaattaaacagtcatcttaactgcaaaataaaacatttctcagtaaatattaaagccagttaccttctatcaacatgttaatgaaagtgctagttgttgcagcaaagaataacaaaggcaatacacgatcaatataggcagtgaaacaaaagtatcatttgcaagttaaaacagacttcccaattttaaatctggtttccccctgaatatgtggcatccttggcagcacttctgagagtggctgctttcattccaagaagcccatgggtttggaggtgggataggtgcctttctggcttctcattgctgcttctagatcagtctccaaatatcccccttccccacattggaatgaatagccatcacagcatggatggaggttagaatgagccagactgcctgggctcaaatcctagcacaccactcactagctggggaccttgagcaagttatttgtcctgttttctgtttccttatatgtaaaagtgggtaaaatggtacatattttgtagggttgttatgaagattgaatgacattatttacaaactgcttagaactgcttgccacctactaaatactgtgtaagtgttcaagaaaaagctgtcttcatttcactcttgttgcagttatctttcattcccagcttggtcactccctcttatttgttgaagagtttagctcccggttcagtgtcaccccattactaataatcattgctgatttcaatatccaagtgatggtctaatacaactccttggcctctcagtcttttttattttttgaggtggagtcttgctctgtcacccaggctggagtgcaatggcaccatctcagctcactgcaacctctgcctccctgatacaagcaatcctcctgcctcagcctcccaagtagctaggattacaggcatgtaccaccacaccaggctaatttttgtattttagtagagacagggtttcgccttgttggccaggctggtcttgaacgtctggcctcaagtgatctgcctaccttggcctccctcagcccctttttgtttcctccagtgagaagatactcagttctatggtcttattctagagccccgtccttttaataacaataactgcacccctccaaaatctcagttttaagcatctcactctccaataaccccatggtgtctacaattttcctgtggtcctcaaccccagcaattctttgaccccactgagatttcaatccattgattctatggctttttcacaggttgtttccctgatgcctgtacttctctccttattcaacttaaattccatggctcatcattatgtcaccctccactgcattgtactcaaactgtcccgacaatccccagccctactggaatccagctctgcctcctccctgcaacacctgcacatcccgtttcctttgctgtttcctcctcatttccctggcccctcaatgtcacaggttttagtactcagagtctgcacctcttttcttctctgtgctcacttatttggtgatctcatccagtctcatagctttaaattatcttagtttgggttctcccagaagcagagcgtaaaacaatgcttcacgtgaaagtaatcagtaggaaattggggaaattgtgtatgaaagagaaagcagccaatgaaaagtttactattaagccagctacggtaagtgggcaattagagtttggtgccccagggagactctggggagtttggcaaaatatatacctcagaattatcccacctaaggggcaagagacctggagtatttatataacaacttgccagggttactgagtgaaggctattctagcacatgttagttactggcttgccatgtgtaccgacacagctgctttccacagtttaaaaagaaagtctgagcaacatagtgacatcccatctttacataaaatttttaaaaaattagcaaggcatggtggtgcacacctgtagtctcagctacttggctgagataggatccctggagtctgagggttcaaggctgcagtgagctgtgatttgtgccactgcaccccagcctgggtgggtggcagagtgagaccctgtctaaaaagacaaaaaaaaaaaaaaaaaaaaagcagcagcagctgaaagttggcaggagcacactggcagttcctaggatcataggatataggcagggcactgaccactcctacaaccaccatctatacactgataactcataaatgtttgtgtccaatccagatctctcctaaatgcttgactgatatattcagctgcctgtggataactgggcatctatctgcacttgaatatctaataaacgtctaaaacttaaaatgac

SEQ ID NO: 173518 - DNA, 923 bp, Homo sapiens
  Payload ID: 14088
  Gene Symbol: RAD50
  Gene Name: RAD50 homolog, double strand break repair protein
  ENST ID: ENST00000416135
  CDS Start-End: 624-923
tcactggtcttccccacttgcatcctttggcacatacatttatgtattaggttctgtaaattatttgcttgggattgtatgactggagaaacatttcctacatttttccaaggcaggcagaggcaaattataccactacagtaattccaaatttgtgtttcatttaaatgtcctccactattgtttcagtaatttttatgtatgtttctctaggcccttaaatgtgatatccctccattaagtttgtttccaagaaagcaatattctcagttacttctgagacaggtaacttctctttcccttatttttaaagatatctattgctgggagcactgatcggaatggattacctctacattcttcatatttgcagactgcttttagttttagttcccagacttttggtcttaaagacgcctttacactaaaaaattacgggggacctcaaagagcgtaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaa

SEQ ID NO: 173519 - DNA, 2915 bp, Homo sapiens
  Payload ID: 14088
  Gene Symbol: RAD50
  Gene Name: RAD50 homolog, double strand break repair protein
  ENST ID: ENST00000423956
  CDS Start-End: 95-1750
tcgcgggtctcacgtcccgtgcacgccttgcttcggcctcagttaagcctttgtgggctccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacac

SEQ ID NO: 173520 - DNA, 1052 bp, Homo sapiens
  Payload ID: 14088
  Gene Symbol: RAD50
  Gene Name: RAD50 homolog, double strand break repair protein
  ENST ID: ENST00000434288
  CDS Start-End: 1-475
ggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaagattgtactggtaaagccacattccatcacctcctgttacaattctttgaagaaatgctttaggaacttgatcccacttattgaggaagttctgctgttgtctgcagctgatctggaagcagtgattttgggcatccatcaagtagaacgtttactcaactttaatttttcagtcagaattgtgtaacctgaatcaattgaggtgtctatggtgttggctattgtttctgctgttaatcattgatcttcttcagttagggcatgaagaagatgattttttttcctcacaaattgatgtgaacagtctgtcactgtgggcttcatctttaatatcgtctcatcccttcttaaactgagttatccatttgtaaactgctgatttgtttggggcattgatctcataaacttgttgtaaagtatcaatgatttcaccattcttccacccacacttcaccataaatttgatacttgttcttgcttcagtttaattggggctcttttcaaactgatgtcttaaccttgttagtgccttaaactagatcctattcagacatgttataacaagttagtatgagtttgtttcagtgcaaaacattttgaacttcatgcatagttttttttataatacacattttccatgaacattttgaagacccctcatattttgcaaattaagtaaaatggtaacggatagtaatttaggcctcttgtcccttgaaaatttgtagacctatgaagattaaaatttaaaaattctattttca

SEQ ID NO: 173521 - DNA, 564 bp, Homo sapiens
  Payload ID: 14088
  Gene Symbol: RAD50
  Gene Name: RAD50 homolog, double strand break repair protein
  ENST ID: ENST00000455677
  CDS Start-End: 1-472
tatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgaatggtcatccagactcagagctctctctacagagaggaaattctccactgtgcacacccacctttggaaagctctgaccacttgaggcctgatctgcccatcgtgaagaagcctgtaacactcctctgcgtctatcctgtgtagcatactggcttcaccatcaatcctgattcctct

SEQ ID NO: 173522 - DNA, 2076 bp, Homo sapiens
  Payload ID: 14088
  Gene Symbol: RAD50
  Gene Name: RAD50 homolog, double strand break repair protein
  ENST ID: ENST00000453394
  CDS Start-End: 95-2076
tcgcgggtctcacgtcccgtgcacgccttgcttcggcctcagttaagcctttgtgggctccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggtgtgtactcagaaaagcaaaaagacagaatttaaaactctggaaggagtcattactagaacaaagcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaa

SEQ ID NO: 173523 - DNA, 4373 bp, Homo sapiens
  Payload ID: 14088
  Gene Symbol: RAD50
  Gene Name: RAD50 homolog, double strand break repair protein
  ENST ID: ENST00000533482
  CDS Start-End: 388-696
ccaggagagcggcgtggacgcgtgcgggcctagaggcccacgtgatccgcagggcggccgaggcaggaagctgtgagtgcgcggttgcggggtcgcattgtggctacggctttgcgtccccggcgggcagccccaggctggtccccgcctccgctctccccaccggcggggaaagcagctggtgtgggaggaaaggctccatcccccgccccctctctcccgctgttggctggcaggatcttttggcagtcctgtggcctcgctccccgcccggatcctcctgaccctgagattcgcgggtctcacgtcccgtgcacgccttgcttcggcctcagttaagcctttgtgggctccaggtccctggtgagattagaaacgtttgcaaacatgtcccggatcgaaaagatgagcattctgggcgtgcggagttttggaatagaggacaaagataagcaaattatcactttcttcagcccccttacaattttggttggacccaatggggcgggaaagacgaccatcattgaatgtctaaaatatatttgtactggagatttccctcctggaaccaaaggaaatacatttgtacacgatcccaaggttgctcaagaaacagatgtgagagcccagattcgtctgcaatttcgtgatgtcaatggagaacttatagctgtgcaaagatctatggcatggtgaaaaggtcagtctgagctctaagtgtgcagaaattgaccgagaaatgatcagttctcttggggtttccaaggctgtgctaaataatgtcattttctgtcatcaagaagattctaattggcctttaagtgaaggaaaggctttgaagcaaaagtttgatgagattttttcagcaacaagatacattaaagccttagaaacacttcggcaggtacgtcagacacaaggtcagaaagtaaaagaatatcaaatggaactaaaatatctgaagcaatataaggaaaaagcttgtgagattcgtgatcagattacaagtaaggaagcccagttaacatcttcaaaggaaattgtcaaatcctatgagaatgaacttgatccattgaagaatcgtctaaaagaaattgaacataatctctctaaaataatgaaacttgacaatgaaattaaagccttggatagccgaaagaagcaaatggagaaagataatagtgaactggaagagaaaatggaaaaggtttttcaagggactgatgagcaactaaatgacttatatcacaatcaccagagaacagtaagggagaaagaaaggaaattggtagactgtcatcgtgaactggaaaaactaaataaagaatctaggcttctcaatcaggaaaaatcagaactgcttgttgaacagggtcgtctacagctgcaagcagatcgccatcaagaacatatccgagctagagattcattaattcagtctttggcaacacagctagaattggatggctttgagcgtggaccattcagtgaaagacagattaaaaattttcacaaacttgtgagagagagacaagaaggggaagcaaaaactgccaaccaactgatgaatgactttgcagaaaaagagactctgaaacaaaaacagatagatgagataagagataagaaaactggactgggaagaataattgagttaaaatcagaaatcctaagtaagaagcagaatgagctgaaaaatgtgaagtatgaattacagcagttggaaggatcttcagacaggattcttgaactggaccaggagctcataaaagctgaacgtgagttaagcaaggctgagaaaaacagcaatgtagaaaccttaaaaatggaagtaataagtctccaaaatgaaaaagcagacttagacaggaccctgcgtaaacttgaccaggagatggagcagttaaaccatcatacaacaacacgtacccaaatggagatgctgaccaaagacaaagctgacaaagatgaacaaatcagaaaaataaaatctaggcacagtgatgaattaacctcactgttgggatattttcccaacaaaaaacagcttgaagactggctacatagtaaatcaaaagaaattaatcagaccagggacagacttgccaaattgaacaaggaactagcttcatctgagcagaataaaaatcatataaataatgaactaaaaagaaaggaagagcagttgtccagttacgaagacaagctgtttgatgtttgtggtagccaggattttgaaagtgatttagacaggcttaaagaggaaattgaaaaatcatcaaaacagcgagccatgctggctggagccacagcagtttactcccagttcattactcagctaacagacgaaaaccagtcatgttgccccgtttgtcagagagtttttcagacagaggctgagttacaagaagtcatcagtgatttgcagtctaaactgcgacttgctccagataaactcaagtcaacagaatcagagctaaaaaaaaaggaaaagcggcgtgatgaaatgctgggacttgtgcccatgaggcaaagcataattgatttgaaggagaaggaaataccagaattaagaaacaaactgcagaatgtcaatagagacatacagcgcctaaagaacgacatagaagaacaagaaacactcttgggtacaataatgcctgaagaagaaagtgccaaagtatgcctgacagatgttacaattatggagaggttccagatggaacttaaagatgttgaaagaaaaattgcacaacaagcagctaagctacaaggaatagacttagatcgaactgtccaacaagtcaaccaggagaaacaagagaaacagcacaagttagacacagtttctagtaagattgaattgaatcgtaagcttatacaggaccagcaggaacagattcaacatctaaaaagtacaacaaatgagctaaaatctgagaaacttcagatatccactaatttgcaacgtcgtcagcaactggaggagcagactgtggaattatccactgaagttcagtctttgtacagagagataaaggatgctaaagagcaggtaagccctttggaaacaacattggaaaagttccagcaagaaaaagaagaattaatcaacaaaaaaaatacaagcaacaaaatagcacaggataaactgaatgatattaaagagaaggttaaaaatattcatggctatatgaaagacattgagaattatattcaagatgggaaagacgactataagaagcaaaaagaaactgaacttaataaagtaatagctcaactaagtgaatgcgagaaacacaaagaaaagataaatgaagatatgagactcatgagacaagatattgatacacagaagatacaagaaaggtggctacaagataaccttactttaagaaaaagaaatgaggaactaaaagaagttgaagaagaaagaaaacaacatttgaaggaaatgggtcaaatgcaggttttgcaaatgaaaagtgaacatcagaagttggaagagaacatagacaatataaaaagaaatcataatttggcattagggcgacagaaaggttatgaagaagaaattattcattttaagaaagaacttcgagaaccacaatttcgggatgctgaggaaaagtatagagaaatgatgattgttatgaggacaacagaacttgtgaacaaggatctggatatttattataagactcttgaccaagcaataatgaaatttcacagtatgaaaatggaagaaatcaataaaattatacgtgacctgtggcgaagtacctatcgtggacaagatattgaatacatagaaatacggtctgatgccgatgaaaatgtatcagcttctgataaaaggcggaattataactaccgagtggtgatgctgaagggagacacagccttggatatgcgaggacgatgcagtgctggacaaaaggtattagcctcactcatcattcgcctggccctggctgaaacgttctgcctcaactgtggcatcattgccttggatgagccaacaacaaatcttgaccgagaaaacattgaatctcttgcacatgctctggttgagataataaaaagtcgctcacagcagcgtaacttccagcttctggtaatcactcatgatgaagattttgtggagcttttaggacgttctgaatatgtggagaaattctacaggattaaaaagaacatcgatcagtgctcagagattgtgaaatgcagtgttagctccctgggattcaatgttcattaaaaatatccaagatttaaatgccatagaaatgtaggtcctcagaaagtgtataataagaaacttatttctcatatcaacttagtcaataagaaaatatattctttcaaaggaa

SEQ ID NO: 173524 - DNA, 2976 bp, Homo sapiens
  Payload ID: 14089
  Gene Symbol: RINT1
  Gene Name: RAD50 interactor 1
  Uniprot ID: Q6NUQ1
  ENST ID: ENST00000257700
  CDS Start-End: 232-2610
ggccgttccgacctccggtcaggagggggaggaacagagcacggccggcggctgcacgggcagggcctctctgggctgagaggaagaaaccagtgagacatcgagaggaagtcgctgtggcactcagtcctacggcctccgaggctgggtagtgagtgtgtcgctggccttagccagactccacaggccacgctggctgcgaatggagccgaggactcgcgcggaggcgagatgctaccagccggcgagatcggcgcctctcctgcagccccgtgctgctctgaaagtggtgacgaaaggaagaacctcgaggagaaaagtgacataaatgttacagttcttattggaagtaaacaagtcagtgaaggtacagataatggtgatctcccttcttatgtgtctgcattcatagaaaaggaagttggaaatgaccttaaatctttaaagaaacttgataaactcatagaacagaggacagtaagtaaaatgcagttagaagaacaggtacttacaatttcatcagaaattcctaaaagaattcgaagtgccttaaaaaatgcagaagaatcaaagcaatttcttaatcagtttctggagcaggaaactcatctcttcagcgccattaacagccatttgctgactgcgcaaccttggatggacgatcttggaaccatgattagccagattgaagagatcgaacgtcatcttgcttaccttaaatggatttcacaaattgaagaactaagtgataacattcagcaatatctgatgaccaataatgtaccggaggcagcctccactctagtgtctatggcagaacttgacattaaacttcaggaatcatcttgtactcatcttcttggtttcatgagagccacagttaaattctggcataaaattctcaaggacaagcttacaagtgattttgaggaaattttagcacagcttcattggccattcatcgcaccccctcaatcacaaactgttggcttaagtcgacctgccagtgccccggagatatacagttacctggagacactgttttgtcagcttttgaaactacaaacctcagatgaattacttactgagccaaagcaactcccagaaaaatactctcttcctgcctccccttctgtcatcctgcccatccaggttatgctgactcctcttcagaagaggttcaggtatcacttcagagggaaccggcagactaatgtgttaagcaagccagaatggtacttggctcaagtacttatgtggattggaaaccatactgaatttctggatgagaagattcagccaatattagacaaagtaggctctttggtaaacgcaaggcttgaattttctcggggccttatgatgctggttcttgagaagttagccactgatattccttgtctgctatatgatgacaatctcttctgtcatttggtggatgaagtactcttgtttgaaagggagctacacagtgttcatggctatcctggcacttttgctagttgtatgcatattctatcagaggaaacctgttttcagagatggttgacggtggagagaaaatttgctcttcaaaaaatggactcaatgctttcctcagaagctgcctgggtatcgcaatataaggatatcactgacgtggatgaaatgaaagttccagattgtgcagaaacttttatgactctactcttggttataactgacaggtataaaaatcttcccacagcttcccgaaagcttcagttcctggagttacagaaggacttagtagatgattttaggatacgattaacacaagtgatgaaagaagagactagagcttcccttggctttcgatactgtgcaattcttaatgctgtgaactacatctcaacagtactagcagattgggctgacaatgttttctttctacaacttcaacaggctgcactggaggtgtttgcagagaataatactctgagtaaattgcagctaggacagctagcctctatggagagctctgtctttgatgacatgattaacctcttagaacgtttaaagcatgatatgttgacccgtcaagtagaccacgtttttagagaagttaaagatgctgcaaaattgtataaaaaagaaagatggttgtccttgccatctcagtcagagcaggcagtgatgtccctgtccagttcggcttgcccgttgctgctgacgttacgagaccatttacttcagttggagcagcagctttgtttctccttatttaaaattttctggcaaatgcttgtagagaagctggatgtatacatctaccaagaaataattcttgctaatcacttcaatgaaggaggagcagcccagctgcagtttgatatgactcggaatcttttccctttgttttctcactattgcaagagaccagaaaattattttaaacatataaaagaagcctgtattgttttgaatttgaacgtcggttctgcactactgctgaaagatgtactgcagtcagcttcagggcagcttcctgccacagcagcattaaatgaagttggaatttacaaactggctcaacaagatgttgagattctacttaatttgaggacaaattggcctaatactggaaaataatgtctttcagaaaaaggtttctttggtttttgtttctaagaaagaggaagccaattggatttcaagttatatgatgaaattctgaattaatgaaactggaaaactttatagaattacttattatcttggatttatggtgttattaaaatgctgaccatatttccttcatcctcttgttcctaaggaaacaaaaacagaaaacgaaacaatgaaaactcaattctatttacaagtataaatgctgagtatgtctgttgaagacgagcagagatattaaattataaccaactttcaatttcctgtgctaattaagggaaattctgttgtggataatcaaacatagccaataaatttttttaaaactcc

SEQ ID NO: 173525 - DNA, 578 bp, Homo sapiens
  Payload ID: 14089
  Gene Symbol: RINT1
  Gene Name: RAD50 interactor 1
  ENST ID: ENST00000482041
  CDS Start-End: 136-261
gacatcgagaggaagtcgctgtggcactcagtcctacggcctccgaggctgggtagtgagtgtgtcgctggccttagccagactccacaggccacgctggctgcgaatggagccgaggactcgcgcggaggcgagatgctaccagccggcgagatcggcgcctctcctgcagccccgtgctgctctgaaagtggtgacgaaaggaagaacctcgaggagaaaaagatgaggtcttgctctgctgtccaggctggaatgtagtagtgagatcatggctcactgcagcctccatctcccaggctgctcaagcaatcctcccacctcagcccacctgagactacaggtgacataaatgttacagttcttattggaagtaaacaagtcagtgaaggtacagataatggtgatctcccttcttatgtgtctgcattcatagaaaaggaagttggaaatgaccttaaatctttaaagaaacttgataaactcatagaacagaggacagtaagtaaaatgcagttagaagaacaggtacttacaatttcatcagaaattcctaaaagaattcgaagtgccttaaa

SEQ ID NO: 173526 - DNA, 563 bp, Homo sapiens
  Payload ID: 14089
  Gene Symbol: RINT1
  Gene Name: RAD50 interactor 1
  ENST ID: ENST00000493041
  CDS Start-End: 133-563
atcgagaggaagtcgctgtggcactcagtcctacggcctccgaggctgggtagtgagtgtgtcgctggccttagccagactccacaggccacgctggctgcgaatggagccgaggactcgcgcggaggcgagatgctaccagccggcgagatcggcgcctctcctgcagccccgtgctgctctgaaagtggtgacgaaaggaagaacctcgaggagaaaaaaaaggaagttggaaatgaccttaaatctttaaagaaacttgataaactcatagaacagaggacagtaagtaaaatgcagttagaagaacaggtacttacaatttcatcagaaattcctaaaagaattcgaagtgccttaaaaaatgcagaagaatcaaagcaatttcttaatcagtttctggagcaggaaactcatctcttcagcgccattaacagccatttgctgactgcgcaaccttggatggacgatcttggaaccatgattagccagattgaagagatcgaacgtcatcttgcttaccttaaatggatttcacaaattgaagaactaagtgataacat

SEQ ID NO: 173527 - DNA, 837 bp, Homo sapiens
  Payload ID: 14089
  Gene Symbol: RINT1
  Gene Name: RAD50 interactor 1
  ENST ID: ENST00000467392
  CDS Start-End: 148-312
agaaaccagtgagacatcgagaggaagtcgctgtggcactcagtcctacggcctccgaggctgggtagtgagtgtgtcgctggccttagccagactccacaggccacgctggctgcgaatggagccgaggactcgcgcggaggcgagatgctaccagccggcgagatcggcgcctctcctgcagccccgtgctgctctgaaagtggtgacgaaaggaagaacctcgaggagaaaagtgacataaatgttacagttcttattggaagtaaacaagtcagtgaaggtacttacaatttcatcagaaattcctaaaagaattcgaagtgccttaaaaaatgcagaagaatcaaagcaatttcttaatcagtttctggagcaggaaactcatctcttcagcgccattaacagccatttgctgactgcgcaaccttggatggacgatcttggaaccatgattagccagattgaagagatcgaacgtcatcttgcttaccttaaatggatttcacaaattgaagaactaagtgataacattcagcaatatctgatgaccaataatgtaccggaggcagcctccactctagtgtctatggcagaacttgacattaaacttcaggaatcatcttgtactcatcttcttggtttcatgagagccacagttaaattctggcataaaattctcaaggacaagcttacaagtgattttgaggaaattttagcacagcttcattggccattcatcgcaccccctcaatcacaaactgttggcttaagtcgacctgccagtgccccggagatatacagttacctggagacactgttttgtcagcttttgaa

SEQ ID NO: 173528 - DNA, 2627 bp, Homo sapiens
  Payload ID: 14089
  Gene Symbol: RINT1
  Gene Name: RAD50 interactor 1
  ENST ID: ENST00000497979
  CDS Start-End: 105-278
tcctacggcctccgaggctgggtagtgagtgtgtcgctggccttagccagactccacaggccacgctggctgcgaatggagccgaggactcgcgcggaggcgagatgctaccagccggcgagatcggcgcctctcctgcagccccgtgctgctctgaaagtggtgacgaaaggaagaacctcgaggagaaaagtgacataaatgttacagttcttattggaagtaaacaagtcagtgaagtttctggagcaggaaactcatctcttcagcgccattaacagccatttgctgactgcgcaaccttggatggacgatcttggaaccatgattagccagattgaagagatcgaacgtcatcttgcttaccttaaatggatttcacaaattgaagaactaagtgataacattcagcaatatctgatgaccaataatgtaccggaggcagcctccactctagtgtctatggcagaacttgacattaaacttcaggaatcatcttgtactcatcttcttggtttcatgagagccacagttaaattctggcataaaattctcaaggacaagcttacaagtgattttgaggaaattttagcacagcttcattggccattcatcgcaccccctcaatcacaaactgttggcttaagtcgacctgccagtgccccggagatatacagttacctggagacactgttttgtcagcttttgaaactacaaacctcagatgaattacttactgagccaaagcaactcccagaaaaatactctcttcctgcctccccttctgtcatcctgcccatccaggttatgctgactcctcttcagaagaggttcaggtatcacttcagagggaaccggcagactaatgtgttaagcaagccagaatggtacttggctcaagtacttatgtggattggaaaccatactgaatttctggatgagaagattcagccaatattagacaaagtaggctctttggtaaacgcaaggcttgaattttctcggggccttatgatgctggttcttgagaagttagccactgatattccttgtctgctatatgatgacaatctcttctgtcatttggtggatgaagtactcttgtttgaaagggagctacacagtgttcatggctatcctggcacttttgctagttgtatgcatattctatcagaggaaacctgttttcagagatggttgacggtggagagaaaatttgctcttcaaaaaatggactcaatgctttcctcagaagctgcctgggtatcgcaatataaggatatcactgacgtggatgaaatgaaagttccagattgtgcagaaacttttatgactctactcttggttataactgacaggtataaaaatcttcccacagcttcccgaaagcttcagttcctggagttacagaaggacttagtagatgattttaggatacgattaacacaagtgatgaaagaagagactagagcttcccttggctttcgatactgtgcaattcttaatgctgtgaactacatctcaacagtactagcagattgggctgacaatgttttctttctacaacttcaacaggctgcactggaggtgtttgcagagaataatactctgagtaaattgcagctaggacagctagcctctatggagagctctgtctttgatgacatgattaacctcttagaacgtttaaagcatgatatgttgacccgtcaagtagaccacgtttttagagaagttaaagatgctgcaaaattgtataaaaaagaaagatggttgtccttgccatctcagtcagagcaggcagtgatgtccctgtccagttcggcttgcccgttgctgctgacgttacgagaccatttacttcagttggagcagcagctttgtttctccttatttaaaattttctggcaaatgcttgtagagaagctggatgtatacatctaccaagaaataattcttgctaatcacttcaatgaaggaggagcagcccagctgcagtttgatatgactcggaatcttttccctttgttttctcactattgcaagagaccagaaaattattttaaacatataaaagaagcctgtattgttttgaatttgaacgtcggttctgcactactgctgaaagatgtactgcagtcagcttcagggcagcttcctgccacagcagcattaaatgaagttggaatttacaaactggctcaacaagatgttgagattctacttaatttgaggacaaattggcctaatactggaaaataatgtctttcagaaaaaggtttctttggtttttgtttctaagaaagaggaagccaattggatttcaagttatatgatgaaattctgaattaatgaaactggaaaactttatagaattacttattatcttggatttatggtgttattaaaatgctgaccatatttccttcatcctcttgttcctaaggaaacaaaaacagaaaacgaaacaatgaaaactcaattctatttacaagtataaatgctgagtatgtctgttgaagacgagcagagatattaaattataaccaactttcaatttcctgtgctaattaagggaaattctgttgtggataatcaaacatagccaataaatttttttaaaactc

SEQ ID NO: 173529 - DNA, 2163 bp, Homo sapiens
  Payload ID: 14090
  Gene Symbol: RAD51AP1
  Gene Name: RAD51 associated protein 1
  Uniprot ID: Q96B01
  ENST ID: ENST00000228843
  CDS Start-End: 51-1109
gaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaagactccctgaaggtacttttagtattccagctagtgcagtgccttgtacaaagatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccagcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctccgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaatttagaattgtgattaaagtgagcatttgtcta

SEQ ID NO: 173530 - DNA, 2113 bp, Homo sapiens
  Payload ID: 14090
  Gene Symbol: RAD51AP1
  Gene Name: RAD51 associated protein 1
  Uniprot ID: Q96B01
  ENST ID: ENST00000352618
  CDS Start-End: 51-1058
gaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccagcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctccgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaatttagaattgtgattaaagtgagcatttgtctat

SEQ ID NO: 173531 - DNA, 2235 bp, Homo sapiens
  Payload ID: 14090
  Gene Symbol: RAD51AP1
  Gene Name: RAD51 associated protein 1
  ENST ID: ENST00000442992
  CDS Start-End: 51-263
gaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggtgagagccatagaaagaaatgacaactgataactgatatatactgcaatatggatgaaccttggaaacatcattctgagtgaaagaagccagatatacagactccctgaaggtacttttagtattccagctagtgcagtgccttgtacaaagatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccagcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaactttaactgttcagttttatctggcagaggaaaacattcttatttctttcagaagacatttctgaaatcttataagctacttaagctacgttgtcagttttatcgcaaagatgttttgtattttagccaaatctttttatagtacaaacttagaattattttacacactaaaatggttgcagttttatggcatatgtctccgatttagatggttattctctagaaaatagtatttaaagacattttatgaaatcttcattgtcaaaacctttaataaaagtggaaatattttgaaatgccctttttcttgataccactcatccacgtgttcctgattgtccacatttcatgataaaatgagagctccgcagagaatgttagcctttctgttgtaaatgtaatcttcaagtagtcactttttgttaagttctttagaaagtagttgtcaagtacttagtcatccctattatgatatgagatagtacagcttttcaggaagcttagatctgaatttactttgaaaaacaattgtaatgaatattttatatttacattgagaatttcaactagcttctgatcaatttttaataaaaaattttcaaatcatgttagctgttaaaaaatgtataataactcagtttttcttggtttatggaaatatctatattaatgtgaaaataattaattta

SEQ ID NO: 173532 - DNA, 841 bp, Homo sapiens
  Payload ID: 14090
  Gene Symbol: RAD51AP1
  Gene Name: RAD51 associated protein 1
  ENST ID: ENST00000536886
  CDS Start-End: 72-287
gcgggaattgaaaccgccgctgaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccaggtatggcat

SEQ ID NO: 173533 - DNA, 1333 bp, Homo sapiens
  Payload ID: 14090
  Gene Symbol: RAD51AP1
  Gene Name: RAD51 associated protein 1
  ENST ID: ENST00000535558
  CDS Start-End: 51-266
gaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccaggtatggcatatttatcatcaaggacaggagcttggaaaattatcactgcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggttgggagaatcacagctttacaagggtgtttatatttgatttgtgtttatatttgaggcaggtattgtaatataaaggaatccattaccatgtcctataaatgacctctagccattttatgattatgttctctgtaaaactcttcaagacttcaatgagaagtttgtttataagaattatcttctcatacctttccttgtgaagagcgtattctgtttttctatcagttcgacatgaagtccacatcacatgctgttcttttctagttacatgatgtgcctttctagctttgtctagtttatagcaccttaac

SEQ ID NO: 173534 - DNA, 566 bp, Homo sapiens
  Payload ID: 14090
  Gene Symbol: RAD51AP1
  Gene Name: RAD51 associated protein 1
  ENST ID: ENST00000544173
  CDS Start-End: 1-207
cataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaagccatagaaagaaatgacaactgataactgatatatactgcaatatggatgaaccttggaaacatcattctgagtgaaagaagccagatatacaggatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcaga

SEQ ID NO: 173535 - DNA, 1036 bp, Homo sapiens
  Payload ID: 14090
  Gene Symbol: RAD51AP1
  Gene Name: RAD51 associated protein 1
  ENST ID: ENST00000398012
  CDS Start-End: 58-270
cgccgctgaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggtgagaggcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggtgacttcggtggactctgctccagctgccgtcaaatcagaatctcagtccttgccaaaaaaggtttctctgtcttcagataccactaggaaaccattagaaatacgcagtccttcagctgaaagcaagaaacctaaatgggtcccaccaggtatggcatatttatcatcaaggacaggagcttggaaaattatcactgcggcatctggaggtagcagaagtagcagcagcccactggtggtagtgtctgtgaagtctcccaatcagagtctccgccttggcttgtccagattagcacgagttaaacctttgcatccaaatgccactagcacctgagtgtggtacaggaggaatgtttggtt

SEQ ID NO: 173536 - DNA, 581 bp, Homo sapiens
  Payload ID: 14090
  Gene Symbol: RAD51AP1
  Gene Name: RAD51 associated protein 1
  ENST ID: ENST00000538817
  CDS Start-End: 34-258
gagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaagccatagaaagaaatgacaactgataactgatatatactgcaatatggatgaaccttggaaacatcattctgagtgaaagaagccagatatacagactccctgaaggtacttttagtattccagctagtgcagtgccttgtacaaagatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatt

SEQ ID NO: 173537 - DNA, 707 bp, Homo sapiens
  Payload ID: 14090
  Gene Symbol: RAD51AP1
  Gene Name: RAD51 associated protein 1
  ENST ID: ENST00000536346
  CDS Start-End: 143-355
gccgcaagcatggctggtgatgattggacgactggtaacagggggcggagggctccgaagtctggttttgggcgggaattgaaaccgccgctgaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggtgagaggatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggt

SEQ ID NO: 173538 - DNA, 773 bp, Homo sapiens
  Payload ID: 14090
  Gene Symbol: RAD51AP1
  Gene Name: RAD51 associated protein 1
  ENST ID: ENST00000536117
  CDS Start-End: 1-773
acataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaaggtaaaatccccagtagaaaagaaagagaagaaatctaaatccaaatgtaatgctttggataccactaggaaaccattagaaatacgcagtccttcagctgaaagcaagaaacctaaatgggtcccac

SEQ ID NO: 173539 - DNA, 567 bp, Homo sapiens
  Payload ID: 14090
  Gene Symbol: RAD51AP1
  Gene Name: RAD51 associated protein 1
  ENST ID: ENST00000544110
  CDS Start-End: 58-270
cgccgctgaagccaacaagaatttgagaactgtaaataccaagccttgaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggtgagaggcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagact

SEQ ID NO: 173540 - DNA, 787 bp, Homo sapiens
  Payload ID: 14090
  Gene Symbol: RAD51AP1
  Gene Name: RAD51 associated protein 1
  ENST ID: ENST00000544927
  CDS Start-End: 11-718
gaaagggaccatggtgcggcctgtgagacataagaaaccagtcaattactcacagtttgaccactctgacagtgatgatgattttgtttctgcaactgtacctttaaacaagaaatccagaacagcaccaaaggagttaaaacaagataaaccaaaacctaacttgaacaatctccggaaagaagaaatcccagtacaagagaaaacccctaaaaaaaggatggctttagatgacaagctctaccagagagacttagaagttgcactagctttatcagtgaaggaacttccaacagtcaccactaatgtgcagaactctcaagataaaagcattgaaaaacatggcagtagtaaaatagaaacaatgaataagtctcctcatatctctaattgcagtgtagccagtgattatttagatttggataagattactgtggaagatgatgttggtggtgttcaagggaaaagaaaagcagcatctaaagctgcagcacagcagaggaagattcttctggaaggcagtgatggtgatagtgctaatgacactgaaccagactttgcacctggtgaagattctgaggatgattctgatttttgtgagagtgaggataatgacgaagacttctctatgagaaaaagtaaagttaaagaaattaaaaagaaagaagtgaagcggcatctggaggtagcagaagtagcagcagcccactggtggtagtgtctgtgaagtctcccaatcagagtctccgccttggcttgtccagattagcacgagttaaacctttgc

SEQ ID NO: 173541 - DNA, 3724 bp, Homo sapiens
  Payload ID: 14091
  Gene Symbol: RAD51AP2
  Gene Name: RAD51 associated protein 2
  Uniprot ID: Q09MP3
  ENST ID: ENST00000399080
  CDS Start-End: 25-3504
gacagatcctttccattcgctgtcatgtctctccctcagcccacgccgcggatggccgagctcagaaagcctacctcctctttaacgcctcctgaggacccggattcccaaccacctagtagcaagcggctctgtcttgaggagcctggaggtgtctttaaggcgggctggcgactgcctctggtgcctcgcttgtctgaggcggaaaaagtctgggagttgtcccctagacccttcaagggactccttgtttcaacgaatgctattttcgataactccacagactcgtgtgtggagaaatcagtcagtgggaagcagatatgtaatctgaaatgctcaaatctcaaattccaaatgagtagctgtttgcagtctcccccctcacaaagtcctgattctgatttgagggcttcaggaaggtctgaggcaggcctgcatgacagagaggctttcagtgtgcaccgcagtaatagctccaaagcaggggttagtcaacttctgcccagcacctctatacacgatatacatggaattagaaatgagaatcgaaaacaacagtttgtccaaggaagagacaatgttcacaaagaaaatccatttttagatgttaccttttacaaggaaactaaatcaccatttcatgaaattaagaacagatgtaaagctaacagtgttgtgccatcaaataaaagagaaaataacatttcatcatctgtactaaaaatatcaaaatctcaaaaccagcccagcttggaaattgccaaacctagctattttagagatagcggcacaataagtgtccctcagtttccaatggacttaaatagcaaaatgtcctctgtctatttaaaggaaatagcgaagaaaaagaatgacaaaaaagaggcatatgttagggatttcacaaacatttactggtcccaaaatagacctgatgttaagaagcaaaagttacagaatgataaaaaaactgtagaagcggaaaacattttttccaaatgttatgaaaatgactacccatcactcagtagccaaaatacttgtaagagaaaagacttgatcagttcaaactactgtaactgcagtagtatccagtgtaatgtaagagactctagaaagaatttcgctatactagaaaatgcaaattgggaggaagcagaatgtctggacagttacgtacttaccaggctggaaaaatctcaaaactgggactgtaacgttagacatattttgagaagaaatagaggaaattgttggattataaataattgcaagactaaatgtgaaaatatgaaaaaaactgaagaaaaatggaattggctattattattagaaatagaccttttaagcaaggaagattaccactgtgcaaaagtcatcaatgcatatgaagaacaatcaaagcttctcgtaagagaaatattaggtagtcagacagctttaataacgactgtttggctaaatggtaaaggagaaaatgataatactctacagttgagatacaatactacacaaaaagtctttcatgtgaacaacccttttgaaagtttcattatagaaattttttatttccataaaagtatttcaggaaataaaaaagataatagtattttaacctgctgtaacattttgaagtgtaaaaagcaaattggtataattggtattcaaaatctaataaccagaaacatgaatacaaatataaagaatggaattttaagcatatatttacaagatagtgtttcagaacctttagatattctattgaaaactaacatagcttttttgctcaataactttgactctttaacaagaattgaaaatgattttgaattagaagaggaatgcattttcaagtgcatgctttatttgaagtatccaaaaaatatagtggaaaatcatactgcatatctagtaaagattttaacttcttcaagactattagaagataatatgaaacctatgttaaagaaaaggaagttatttagaactgaacaagtttttgaaaagtctaagaaaaaactcattaattccttcagtatgacaactcaaaatacaggttttccgatttttgaaacatatgaaaaaattccccttttaatggactttgatgacatggatgaaatttctttaataagagaaattacttgtcagaatatgagttgtcctcaacaagttgtgaatgtggaaaattgggctcactataattctagtactgttaaagcacatggtaattcttgtcctcaatttatacagaacaaccgaggatacattaatgaaaatttttatgaagtaaatatgcacagccaagatttaaatatggaaagaaaacagggacataataagatcagtaactttgactgtgagcacatatttgaagatctctgcaatgttaggcaacaggccataccagcaagccacaacataatacataatgaagagacccataccacttctataactcaagtactaaatttttggaacttgctaagtgaaatagaagaaaaaaaatatgacttaattttgaaagaggaagtaaaagtcacagctgaaagtttaacaaatagttgccaagttcacaaagatactaagatagaaaaggaagagaaagatagtttttttccaatggatgacatgttttctgtacagtcagtttcattaataagtaaggaagtaaatgtggaagaaaataaatatgttaatcaaaattatgtaacaaatacaaatgaatatgagagtattttgccagaaagggagatagctaattcaaaggattttcacagaaagaatgactctgcattatatattaatcatcaatttgaaactggtctgagtgaagggaatgatgaatgttttcaggacttagctgctaaatatttatcaacagaagctctgacaatagtaaaagattttgagatgaagagaaaatttgacttagtacttgaagaacttcgtatgtttcatgaaattagtagggaaaatgaacttctaagcactgtggaaacaaacaatgggcaagaaaattactttggagaaaatgatgctgagaaggtaaaaatggagatagaaaaagatttgaaaatggttgtggtcaacaaaatacgtgcatcttcctcgttccatgatactatagcaggtcctaatatgggcaaaagtcaccaaagtttatttaaatggaaaactgtacccaataatggagaacaggaagttcctaatgagagttgttatccaagtagatcagaggaagaattactttactctacttctgagaaagattgtgaaacacctttacctaaaagacctgcttttctccctgatgaatgtaaagaagaatttaattatttattgagaggaggtagtcactttccacatggcatttcaagagtacgaccgcttaagacatgcagtaggccaatcaggattggtttgtcaagaaaagcaaggattaaacaacttcatccttatctgaaacaaatgtgttacggaaacttaaaagaaaatttttgactttcatatttcaaaacattttacaacatctagaaatgttttgttttctttggatatatgttcttccagcttgggggtttggggcttgctttattataaagtggagaagtttttttttttgagtgtataaattatggtattacctttcaaagttataaaatattttatggatttttatatgatataaaaatgtacacattaaagccgtttcattattgga

SEQ ID NO: 173542 - DNA, 922 bp, Homo sapiens
  Payload ID: 14092
  Gene Symbol: RAD51B
  Gene Name: RAD51 paralog B
  ENST ID: ENST00000390683
  CDS Start-End: 45-884
gtaaagggtggggaaacttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagtaagtttttctttttttctcttttttcttttcctttcttttgtttcttttatattacattcactgacttatggtatcaaataataaaattagaggaaaatgtaaaacagatgactttttaa

SEQ ID NO: 173543 - DNA, 1615 bp, Homo sapiens
  Payload ID: 14092
  Gene Symbol: RAD51B
  Gene Name: RAD51 paralog B
  ENST ID: ENST00000479335
  CDS Start-End: 78-404
gttgctttgcggcgttttccgcggggaaactgtgtaaagggtggggaaacttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagaggatggtacataactagtgccaattcagatgcagaggggagaagttaattcattccatacaatggatgtcttgggcttaattctctcctgggaacccagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaaggccaagagaagccatagggatactgtgacctttgtctagagttgatgggggtgtgatttgtgaaataaaacaggaccgtactgcttggaagaaggaaacggaagctgacataatggggattaattagttgattgctgttgagatggtaacagatttgctcctaaaccattgagctagcgatttcagacctagcagggaaggtgaagatgaagaagcctttgttcaggtctctagatgtgtagggctgagggctttgccgccatgggatgtcaacagccataataataatttgcacttatatagcacctttcaaccaggcacctcaaagcggtttaaccacattaattaattaaagcccacaatcctcctggggagaggaggaggatgactaacaagatttgtaa

SEQ ID NO: 173544 - DNA, 568 bp, Homo sapiens
  Payload ID: 14092
  Gene Symbol: RAD51B
  Gene Name: RAD51 paralog B
  ENST ID: ENST00000485181
  CDS Start-End: 169-568
cttggatccatgaagagttcctgtttcagttcgttccagaggatacttctttaccatctcaatgagatatacagcttctcctttgtatgcattaagagactcacagtaattcttttttagctctgtgaagataaatctttcatgagcctcatttacccctagcaaggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggat

SEQ ID NO: 173545 - DNA, 1536 bp, Homo sapiens
  Payload ID: 14092
  Gene Symbol: RAD51B
  Gene Name: RAD51 paralog B
  Uniprot ID: O15315
  ENST ID: ENST00000471583
  CDS Start-End: 49-1101
ctgtgtaaagggtggggaaacttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaaggccaagagaagccatagggatactgtgacctttgtctagagttgatgggggtgtgatttgtgaaataaaacaggaccgtactgcttggaagaaggaaacggaagctgacataatggggattaattagttgattgctgttgagatggtaacagatttgctcctaaaccattgagctagcgatttcagacctagcagggaaggtgaagatgaagaagcctttgttcaggtctctagatgtgtagggctgagggctttgccgccatgggatgtcaacagccataataataatttgcacttatatagcacctttcaaccaggcacctcaaagcggtttaaccacattaattaattaaagcccacaatcctcctggggagaggaggaggatgactaacaagatttgtaattacaggagggaacatttccgaataaagtattgtctaccagataaaaa

SEQ ID NO: 173546 - DNA, 2596 bp, Homo sapiens
  Payload ID: 14092
  Gene Symbol: RAD51B
  Gene Name: RAD51 paralog B
  Uniprot ID: O15315
  ENST ID: ENST00000487270
  CDS Start-End: 49-1203
ctgtgtaaagggtggggaaacttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagagacaacattttgctctgtcacccaagctgaactgaactgggctccagaaatcctcccacctcagcctcctgagcagctaggactacagatgtgccaccatacccagctaattttttaattttttgtagaggtggggtctcattatgttgcccaagctgatctcaaactcctggcttcaagagatccacccacctcagcctcccaaagcgctaggattacaagtatgagactttgccattccaatgagaattttgtccttagcaatctcatccaatggccactggagatgtgtgtagggccacaagaatgagaaagggggcaatggagtgacaggtgacctgctcaggtgcccctccccagaccaaatgtcccaggcacacagcccatgccctccaccatggagtacattttctccctggcttgctgctgagctaaaggaccagggacgtggaaacaggaggtgaactaaggcaccccgccacccactgtggcagcttgaatttcttgaggctgagacaaactaggatccagtagcctagattttgccccagtttctccactgagtatttactcagtgctcctgagccgatgccttcccctctgcctagatgaaccacagcattttggtaaatgcctcagcatgttaggagcgctggaacgtttattctcttccctcccaattatccactctaatggagcagaacacttacatggaaaatcctaaacatggaagatgatttaaaaatgattcaccctggaatacatgcttccagttgcttctacaggtttaccttgctaaaggcatttcgcttcctttgctgttacaataagcttgcctgccttgaagaaaagaagaccagggccaaagggaaatcagtcaagggagcctgttttgtctgaaataatgcatccatgaacaaatgaattgagtataactgtctttttacatcagtgtttctgtggaattaagagaacatccaaggccactcctagcttgagtagattaaatttgtccttgtgtttggagcaagggttgtgaagtctgtctggcccatcaaatgaccaatggcttttaaggaaggactaagtgacttatgaccagaacaagggagcagcctgagtcagtctccccaatgtctacattgtgttatttatactagcaaaaaaatagacacaactaaatgttcgaccatatggtattggttaaattaacatctatacgatggaatactagatggtcattaaaattatgtgtcagaagaaggcttaatctcatgggaaagtgttcacaccatattattaaagagaaaaaacagattataaagcaatatgcatacaatgtagtagttctgtaagaaaaaagtattatgtgcattttaactggaaaaatatgtataaaaatgttaacagtgcaatctctgggcaataagattatacttgacttttatttcttttttggaattgtcttttttttttttttttcaagtttcctcccattaacatgcatgttc

SEQ ID NO: 173547 - DNA, 1673 bp, Homo sapiens
  Payload ID: 14092
  Gene Symbol: RAD51B
  Gene Name: RAD51 paralog B
  ENST ID: ENST00000487861
  CDS Start-End: 78-1355
gttgctttgcggcgttttccgcggggaaactgtgtaaagggtggggaaacttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagttgttagaactgtggccagagtcagccccaggtcagaatgctggtcagcagcagactcacatcccagccctaccttcctgatacctgatgtggtgctcagaaaaacaaggaatcccaggctgttacccagtgtctccatgtgccctccacagatgcactcaactgtcctctcttctgctcttcctcctacaaactgggcaactggaatcagaacagagactttggatgagcatccagtgtaacccagcctagtttttcaccacgacttccagatctacatttaacatccgacagcaactataattctactttctgaacctccagggaagttgcttccttgtccctttcagcaaaggatgtcatggttttacaatgtctccagtgaaaaagttcttcttctctacatcttcctcccactcctacaacccttgatccccacgtgagatctcatttcctccagctgggtcttctgcagagtgattagagcttctgccctccttgcagcatctctattgtaaaaggattgctgaagcttattaagccttgcagctcctaggagg

SEQ ID NO: 173548 - DNA, 1550 bp, Homo sapiens
  Payload ID: 14092
  Gene Symbol: RAD51B
  Gene Name: RAD51 paralog B
  Uniprot ID: O15315
  ENST ID: ENST00000488612
  CDS Start-End: 28-1128
ttgaaagttggatgctgcagacccggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtctgctgatttctcaccagcattcttatctactaccctttctgctttggacgaagccctgcatggtggtgtggcttgtggatccctcacagagattacaggtccaccaggttgtggaaaaactcagttttgtataatgatgagcattttggctacattacccaccaacatgggaggattagaaggagctgtggtgtacattgacacagagtctgcatttagtgctgaaagactggttgaaatagcagaatcccgttttcccagatattttaacactgaagaaaagttacttttgacaagtagtaaagttcatctttatcgggaactcacctgtgatgaagttctacaaaggattgaatctttggaagaagaaattatctcaaaaggaattaaacttgtgattcttgactctgttgcttctgtggtcagaaaggagtttgatgcacaacttcaaggcaatctcaaagaaagaaacaagttcttggcaagagaggcatcctccttgaagtatttggctgaggagttttcaatcccagttatcttgacgaatcagattacaacccatctgagtggagccctggcttctcaggcagacctggtgtctccagctgatgatttgtccctgtctgaaggcacttctggatccagctgtgtgatagccgcactaggaaatacctggagtcacagtgtgaatacccggctgatcctccagtaccttgattcagagagaagacagattcttattgccaagtcccctctggctcccttcacctcatttgtctacaccatcaaggaggaaggcctggttcttcaagaattttggcacatttgcatatctggtttctcaatccagaacagactaaaagaaaatgagtcctgagattgctacagatgagacccacccatcggagccaggctttgaaggaactgaccgcagtgtgcatgaggaagtacttcacggtgatgaccctcgccaccctctcaggaaaacacagtgacctctcccccaacatccccttcccactcccaggtcccccggcaaaggcagaagaaccaagcaagcctttccaccaaagcagccatgaaccccattctcatcctttccaagaactctctgctataccagataggggtttggggttctgttttccattttttaaaaaaatcatttcaagactcttgaacagtgtgtcggtttacactattctatcttcttaagccaccatatcaacatattcactctgcttcctttcttttcatttggcagatgccacacttttaatggcagcaataaaaggtgtt

SEQ ID NO: 173549 - DNA, 292 bp, Homo sapiens
  Payload ID: 14092
  Gene Symbol: RAD51B
  Gene Name: RAD51 paralog B
  ENST ID: ENST00000554575
  CDS Start-End: 1-108
gattcagagagaagacagattcttattgccaagtcccctctggctcccttcacctcatttgtctacaccatcaaggaggaaggcctggttcttcaagctggaaaatgaaaacattaaccttgattcaagactttgaaaactgtcgcaacccattggtgggtcatgaagtgaaattgatgaatcacaaccagcatttgaaaacagagagagagagaagacagaagaaagagtgaagaaaaaatatcagattatatcacacatattgtttcatttcataaaatatttcttgtgt

SEQ ID NO: 173550 - DNA, 249 bp, Homo sapiens
  Payload ID: 14092
  Gene Symbol: RAD51B
  Gene Name: RAD51 paralog B
  ENST ID: ENST00000553334
  CDS Start-End: 25-249
cttttctttgctggatctggaggcatgggtagcaagaaactaaaacgagtgggtttatcacaagagctgtgtgaccgtctgagtagacatcagatccttacctgtcaggactttttatgtctttccccactggagcttatgaaggtgactggtctgagttatcgaggtgtccatgaacttctatgtatggtcagcagggcctgtgccccaaagatgcaaacggcttatgggataaaagcacaaaggtct

SEQ ID NO: 173551 - DNA, 2591 bp, Homo sapiens
  Payload ID: 14093
  Gene Symbol: RAD51C
  Gene Name: RAD51 paralog C
  Uniprot ID: O43502
  ENST ID: ENST00000337432
  CDS Start-End: 72-1202
gacgtcacgccgcacgccccagcgagggcgtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaatccagatcatatgaagtgaatgggaaaaatacctaaatatgattctgtgaaagtttttctaaagcagtattctgcaattatattttaccctgttttcattttcagtaacattcagtagagatgattattatatttcacaaatgtggaaagctgatctcatgtggccagtctgaatttaccattcatactgttttcacccctttctttcccagttgcctataaaatcttaggaagaaacatatcatattcttattgtgtttttttttttttttttttttttggagatggattctcgctctgtagtccaggctggagtgcaatggcgcaatctctgctcactgcaacctccgcctcccaggttcaagcgattcatctgcctcagcctcccgagtagctggggttacaggcacctgccatcgtgcctggctaattttttgtatttttgtagagacagagttttaccatgttggccaagctggtcttgaactcctgacctcaggtgatctgcctgcccctgcctcccaaagtgctgggattacagtcgtgagccactgtgcccagccatgttctttttaaatgtaaatttgataattctttaaaattacccgcttttataattataaaagagaagccagcaccatgagtcagcatattattctgttcagttttataggtaagatacaaattttaggtgaccaaactgattttagtgacctcaatcctaaaatctaagccatttgtttagcttttaatgacattttataatgttaaagggaggactttggagctgttatctcatctagagattgtttggaacatatgtcttccagaataggttgataagctcacaatcatttattgctacgtttttgtttttgttttgagacaaggtctcactccgtcacccaggctggagtgcagtggcatgatcatagctcactgcagcctcgacctcccgggctcaagcaatcctctcacttcagcctcctgagtagctgggactacagggaggcactaccatgccctgctaatttttggatttttttgtagagacaaggtctcactatgttgcccaggctggtctcaaactcctggtctcaagcgatcctcttgccttgtcttcccaaagtgctgggattacagatgtgagccaccacacctggcctcatttctatattttgaaacacggtatgatccattctagaattctagttgttatgttgacatttttctttgaataatcttaactttgcttaaataaattaaagatttcaattctc

SEQ ID NO: 173552 - DNA, 567 bp, Homo sapiens
  Payload ID: 14093
  Gene Symbol: RAD51C
  Gene Name: RAD51 paralog C
  Uniprot ID: O43502
  ENST ID: ENST00000421782
  CDS Start-End: 17-424
agcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagcttacta

SEQ ID NO: 173553 - DNA, 779 bp, Homo sapiens
  Payload ID: 14093
  Gene Symbol: RAD51C
  Gene Name: RAD51 paralog C
  ENST ID: ENST00000413590
  CDS Start-End: 1-772
agaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaagcaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaa

SEQ ID NO: 173554 - DNA, 639 bp, Homo sapiens
  Payload ID: 14093
  Gene Symbol: RAD51C
  Gene Name: RAD51 paralog C
  ENST ID: ENST00000425173
  CDS Start-End: 1-639
ctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggcccactgcagtagcagaatcaccctactgctctgtggggtggccctgccccttcctctctctgcaagggccccaccctctgaaaccaaggacgacatagcattgccccctgggcttatggttcgactagtgatagtg

SEQ ID NO: 173555 - DNA, 1253 bp, Homo sapiens
  Payload ID: 14093
  Gene Symbol: RAD51C
  Gene Name: RAD51 paralog C
  ENST ID: ENST00000487525
  CDS Start-End: 39-443
ggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgaacaccgaaaagctttggaggatttcactcttgataatattctttctcatatttattattttcgctgtcgtgactacacagagttactggcacaagtttatcttcttccagatttcctttcagaacactcaaagccccaaacgtcttaaccggttccatcatcaactctaaaagtcccaggcttcatctaaatattatctaaatcagagattggtgagactcaagttataattcatcctgaagtgaaattcccttccagctgtgaacgtttgaaatcaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaagcaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatg

SEQ ID NO: 173556 - DNA, 2077 bp, Homo sapiens
  Payload ID: 14093
  Gene Symbol: RAD51C
  Gene Name: RAD51 paralog C
  ENST ID: ENST00000475762
  CDS Start-End: 43-201
gtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgaggaagcatagaaagaatattctcttacgtaattaactgaaacacccaaaacctcatattccagagcattgcagatgggaaccactgcatcctgagacatacaaatatgaggctggcggtggtcacttgttgtgcacatctctctatgacatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaataagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaa

SEQ ID NO: 173557 - DNA, 1098 bp, Homo sapiens
  Payload ID: 14093
  Gene Symbol: RAD51C
  Gene Name: RAD51 paralog C
  ENST ID: ENST00000482007
  CDS Start-End: 30-434
ctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaa

SEQ ID NO: 173558 - DNA, 1609 bp, Homo sapiens
  Payload ID: 14093
  Gene Symbol: RAD51C
  Gene Name: RAD51 paralog C
  ENST ID: ENST00000486827
  CDS Start-End: 39-197
ggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaaggtaacgactcctgatggcaagctgaggcacaccggccgccgtcagcgccgcctcagtcttcgttctctcgcctcggccttcagcccagtctccgttagattctgcttcctcccacgtccatgtttacagcgtgaaagagctcctcgactccacttacaagttgtctgaatggttaggagaactgtggtcgtgaaaacatttactaattgcttttcctctggcaatgcctgctgaatgctttgaggattgtctcatttaaccctcaacccgcttacgtagattattatattcagtatatggatgagagaactgatatcttggggagcttaggtaacttttcatgctaactgggttaggaaatactggagtcagaattggttgtctaatttttgctgttccaagatccaaggggtaagggttaaatttcagaaatgcaggattttgtgtaggactagagacactaagaatgagaaagagagtagaatccccggaatcttgaggaagcatagaaagaatattctcttacgtaattaactgaaacacccaaaacctcatattccagagcattgcagatgggaaccactgcatcctgagacatacaaatatgaggctggcggtggtcacttgttgtgcacatctctctatgacatgtctggacctgtgctattcactgaagaagatggaacagaattttaagttactgcccttactgatggaaaatacagaggtttcaattcgcctctaaagaataagtctcgtggacccagccttaactgtttaagtcataccgcgcgcagactgtgtcccccaagatttgatgggctcttttttcttcaacaagttggcttttcaaagaagaaatgtgagaccctgaataataatgatcactaacaactattgactactttagatggtcttgatattctaccaagctttttacatgtatcgtctcattcccattttatagacgaaaaaaatctgagcaaaaaagaaaaagtgaagtaacttgcccaaagtcatgcaaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatggtaaaataaagtgttctccttttaagggtgggtttaataacatattatgaaagtagtattttgtactatcgtcaggaaaccaaataagatatatatgtgctcttaattttaagtgtgtatgtgcattaaacaaaaattagctta

SEQ ID NO: 173559 - DNA, 1319 bp, Homo sapiens
  Payload ID: 14093
  Gene Symbol: RAD51C
  Gene Name: RAD51 paralog C
  ENST ID: ENST00000583539
  CDS Start-End: 72-1112
gacgtcacgccgcacgccccagcgagggcgtgcggagtttggctgctccggggttagcaggtgagcctgcgatgcgcgggaagacgttccgctttgaaatgcagcgggatttggtgagtttcccgctgtctccagcggtgcgggtgaagctggtgtctgcggggttccagactgctgaggaactcctagaggtgaaaccctccgagcttagcaaagaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaaggaatgcacagtactgtttcaaatcaaagtcagtattatttgattagagtgggattttgatattgatgggcggtaattatctaaagagagaatttacaacttgcttctgtcaacttctgtaggcagcaagcatatttgaggacagcttttgatgcttagaacattgtccccaaaatagtagtatatacagaatattgtagtcacaaatggactgaaatttattcttaagagcagaggaaatacttatttt

SEQ ID NO: 173560 - DNA, 723 bp, Homo sapiens
  Payload ID: 14093
  Gene Symbol: RAD51C
  Gene Name: RAD51 paralog C
  ENST ID: ENST00000584617
  CDS Start-End: 1-143
gctttgaaatgcagcgggatttggtgagtttcccgctgtctccagcggtgcgggtgaagctggtgtctgcggggttccagactgctgaggaactcctagaggtgaaaccctccgagcttagcaaagtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggggaaagttggggacatgctgctacaatacggctaatctttcattgggaccgaaagcaaaggttggcaacattgtacaagtcacccagccagaagga

SEQ ID NO: 173561 - DNA, 474 bp, Homo sapiens
  Payload ID: 14093
  Gene Symbol: RAD51C
  Gene Name: RAD51 paralog C
  ENST ID: ENST00000584804
  CDS Start-End: 1-324
gttcgactagtgatagtggatggtattgcttttccatttcgtcatgacctagatgacctgtctcttcgtactcggttattaaatggcctagcccagcaaatgatcagccttgcaaataatcacagattagctgtaattttaaccaatcagatgacaacaaagattgatagaaatcaggccttgcttgttcctgcattaggttggcaacattgtacaagtcacccagccagaaggaatgcacagtactgtttcaaatcaaacctcagggatttagagatactgttgttacttctgcatgttcattgcaaacagaaggttccttgagcacccggaaacggtcacgagacccagaggaagaattataacccagaaacaaatctcaaagtgtacaaatttattgatgttgtgaaatcaatgtgtacaagtggacttgttaccttaaagtataaataaacacactatggcatgaatgaa

SEQ ID NO: 173562 - DNA, 726 bp, Homo sapiens
  Payload ID: 14093
  Gene Symbol: RAD51C
  Gene Name: RAD51 paralog C
  ENST ID: ENST00000461271
  CDS Start-End: 320-726
gacgtcacgccgcacgccccagcgagggcgtgcggagtttggctgctccggggttagcaggtgagcctgcgatgcgcgggaagacgttccgctttgaaatgcagcgggatttgaagttgggatatctaaagcagaagccttagaaactctgcaaattatcagaagagaatgtctcacaaataaaccaagatatgctggtacatctgagtcacacaagaagtgtacagcactggaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaacaccgaaaagctttggaggatttcactcttgataatattctttctcatatttattattttcgctgtcgtgactacacagagttactggcacaagtttatcttcttccagatttcctttcagaacactcaaaggttcgactagtgatagtggatggtattgcttttccatttcgtcatgacctaga

SEQ ID NO: 173563 - DNA, 686 bp, Homo sapiens
  Payload ID: 14093
  Gene Symbol: RAD51C
  Gene Name: RAD51 paralog C
  ENST ID: ENST00000622327
  CDS Start-End: 1-396
gaacttcttgagcaggagcatacccagggcttcataatcaccttctgttcagcactagatgatattcttgggggtggagtgcccttaatgaaaacaacagaaatttgtggtgcaccaggtgttggaaaaacacaattatgtatgcagttggcagtagatgtgcagataccagaatgttttggaggagtggcaggtgaagcagtttttattgatacagagggaagttttatggttgatagagtggtagaccttgctactgcctgcattcagcaccttcagcttatagcagaaaaacacaagggagaggaatctggctctaccgcccgggctggagtgcagtggcgcaatcttggcttactgcgaccttcacctcccaggttcaagcgattctcctgactcagcctcctgagtagctgggagctgcgaatacaggcacgtgccaccatacctggctaatttttgtatttttagtagagacagagtttcatcatgttggccagactggtctcaaacttctgacctcaagtgatcctcctacgtcggcttccctaagtgctgggattatgagtgtgaacacctgtgcccagctccaaatctaaccaaacttttgagttactaatctctggactcccctgtgttgttacatgcactatgcacaattaataaactctttctcttgttaatcc

SEQ ID NO: 173564 - DNA, 1353 bp, Homo sapiens
  Payload ID: 14094
  Gene Symbol: RAD51D
  Gene Name: RAD51 paralog D
  Uniprot ID: O75771
  ENST ID: ENST00000335858
  CDS Start-End: 133-783
ctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccg

SEQ ID NO: 173565 - DNA, 9988 bp, Homo sapiens
  Payload ID: 14094
  Gene Symbol: RAD51D
  Gene Name: RAD51 paralog D
  Uniprot ID: O75771
  ENST ID: ENST00000345365
  CDS Start-End: 257-1243
ctggaacccggaagcggcagcgcggcgcgacccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacagaaatgatcaggattggttactggccacatcttttaaaggaaggtcatctttcttggttagagagcctgttgtgtaattaatcagttatgtcttggctgcaggaaaggagggtccgagttacactcagaaagtaatgacatttagaggtgatgaatgcaacagggatagaatcatggaggattgggaaggagtggcaaactggcaccagggtgttggattcaggacagggttggtaagcctaagcctgggggaatcctagcgcttgctttcacagaagacctcaggagaaattaatcttcagtatctttataccatgggtgattggcacattcctgcaaccacagtaagatgcaatacatgaagctggaaattgcaaattcttgccactcaaggtactatttgggcatcttcagcccacagcagacatgaccaatcgggcacaagcactcttttttgtggaagtcaaagtgtttttagaagtttttctcaatatagcactccagggggccactaccagtcagttggagttggtattcaaggtggagtctggttgccgtctctgccctgttcccattatgtagtgagttcaggtacttaatacctaactgaggaccctaggactgcagtttgagatcatctggggccaggcacagtggctcacacctataatggtagcactttgggagcctgaggcgggaggatcacttgagcccaggagtttaacagtttaaaatcagcctgggcaacatgatgagacatcgtttctacaaaaaaattttttaaattagctaggcattgtgatgtgcacctgtggtccctgctacttgggagcctgaggcaggagaatcgcttgaaccttggaggttgtggctgcagtgagccctgatcgcaccactacaccccagcctgggtaacagagcaagaccctgtctcaaggaaaaaaaaaatcatctggcccatcctgttacttaacagagaaggtacctgaggctcaaaaaggatgactgacagtcctagtggcagaatggaggtgggatctggaacccacaacttgattcctaggactcttttttttttaattcccacattggctgggtgtggtggctcacgcctgtaatcccagcactttgggaggctgaggtgggtggatcacctaaggtcaggagttccagaccagcctgaccaacatggtgaaaccccgtctgtactaaaaatacaaaaattagccaggcatggtggcccatttcctgtaatcccagctactcaggaggctgaggcagaatcgcttgaacctgggaggcggaggttgcagggagctgagatggcgccactgcactccagcctgagcgacagagtgagactccgtctcaaaaaaaaaaaaaaaatgcaaaaattagccaggcgtcgtggcgcatgtctgtaatcccagctcctcgagaggctgagtggggaggatcacttgagcccaggaggcagaggttgcaatgacctgcgatcatgccactgcactccagcctgggcaacagagactctgtttcaaaaagaaaaaaaaaatccccacattttatttaattttcagtccatacagttctattcctgctagggctgtaactccagctgaaggcaccacagctgtcacccaaggagtttctgtggccatgggaaggtgttgcattcactgctacttgagaccaccacgtgacattcctgcaggctgtgcccctcacagccagcttcatcctttggctcctcctagaccaggactttgtcttgcctgcctgctgccactgcactctgttccggccacaccacactgtgcagtcccctggtaggacttgggctaggctggctctcctgtccaagtgccttttgctccctttgcttatgtgtctgtctctgcccagctcccactgtgtctggtgcacacccaccctgacatccttttttatgcctcagctgtgatctagatagatgcttacagtaacttccctgtattagttattcacttgtactttctgttcacgtgtctgcctacaggctcccactttttgtcactttttctctttatacattatggaagctcagtaatgattaaatagatgaatgatgttttaaaaatatattttaaaaaagcaaaggactggctctatctcaggggttccttccataaagcgtcaactttcaatttcccctgcgggggtggtttgagacctgagggcactctctagttcttaggaaaaaaatatacatatacatatacatatatatatatatatacacacacacacacacacatatacacacatatatatacatatatatacacacatatatatatatacacacatatatatacacacatatatatacacatatgagccaggcgcagtggctcacgcctgtaatcccagcactttgggaggccaaagtgggcggatcacaaggtcaggagttcaagaccagcctggcctatatagtgaaaccctgtctctactaaaaatacaaaaattagctgggtgtgatggctcgcatctgtaatcccagctacttgggaggctgaggcatgagaatcgcttgaacctgggagatggaggttgcagtgagccgagattgtgccactgtactctagcctgggcaacagagtgagactccatctaaaaaatatatatatatgttcacacccacatcattgagtccccagagtgtcttcttacatatctttttacaggggactattgtatgcccttcgtctgacatcagatgaaattaatgttgagatcctactatgtgctagcacttgatggccttaattaaaaatcaggcatttgaattcccaaggactcaggcaaaggtccatgtatcattaaggctgcaagtaacaaaacctaggcttaaagaagtgtaaatactagggacacttatttatatttatttcttttatgtttcaagacagagtcttgctctggagtgcagtggcacaatcacggctcactgtaccctctacctcccaagctcaagtgatcctcccacttcagtctcccaagtagctgggactacaggtgtgtgccaccacacccatctaagttttgtattttttgtagagacggggtctctgtacgttgcccaggctggtcttgaactcctgggctcaggtgatctacccgccttgacctcccaaagtgctagggattacagtcatgagccaccatgcctggcagggacacttattatctctgataacaggaagtctgaggtttgttaatttagtggctcattgtcaaatggcgtagagcctttgcatccttctgctctgttcttttatgttggttttgtcttcaagcttgttccccttatgaaagcctggctgcagccattttgagcatcaatccagacgtgacaatatctacaggcaggagaaggatcgcctcctgtgtgtcctttaaagaacaaggtgttaacatgccaggaactgtggctcctgactgtaatcccagtaatttgggaagccaaagtaggaggatcgcctgaggccaggagttccagaccagcctgggcaacatagcaagaccctatctctataaaataaaataataaaaattaagaaaacaaggtgttaaaagacaaaattaaagcaaatatagttttgcagattgtaattgacttttatttgcaattctagaattgggctgccctcagaaccaggacaggttcagagaattccagagctgcaacatagtctgaaagcatttatggtcagaaaacagaaatgagatacaaagacaactaattggttacagctctgcctttgccttatttgaaaatggtttgaatagttggctgcctggaacccactgaagctgatgatgtgattggctgagcctcagcaatctgttacaaaagtatactcctaaattaggttttcagttagtttgcatactaaggctgcagtttgttaagggcccaagtaaagcctcctcaggtcaattttttttttctttttgagatggagtcttgctcttgctcaggctggagtgcagtggcgtgatctcagctcactgcacctctgcctcccgggttcaagtgattctcctgcctcagcctcctgagtagctgggactacgactacaggcgcctgccactatgtccggctaattttttgtatttttagtagagatggggtttcatcatgttggccatggctggtctcgaactcctgacctcagatgatctgcctgcctcagcctcccaaagaactgggattataggcatgacccactgtgactagccctcaggccaaatttagcttttgtttgtttgtttgagacggagtctctgtcacctaggctggagtgcagtggcatgatcttggctcactgcaacctctgcttcctgggttcaagcaattctgccgcagcctcccgagtagctgggattacaagcatgcgcccccatccccggctctttttgtatttttagtagagatggggtttcaccatgttggccagactggtctcaaactcctgacctcaggtgattcacctgcctctgcctcccaaagtgcctggattacaggcgtgagacaccacacccgaccccaaatttaatttaacaaaggactaactcagaactaacttccaaccaaagctgactcacctcaaatctcattggtgcagaattgcttcatacacccatgtgtaatacagtaactggcaagaaaaagggactgctgtgattgactcaaaccaactaggaaatagccctggagctgaggctggggacaggctttcctgaagcacatgctggagccactgaaagaaaaatgggagttctcctttctactagaaaggagagtgtgtggatgaactggatgctgggtgggcagcctctcactagtacttacggtagtaccaaagacgagttaatcaaggctctattatgtatccttaggcccttgatgcatgtctcattatgaccttaggacagccttgtggcagagggaatgattccatttaatagacagtaaatgggatctcagtgaggttaaggacataaagctaataagtggcagcacgggaatccagacacatgtctgcctgataccaaacccattttttcccatctgcacgctgccttctgctgtaaatatgtaaatgtttccacaaaattctttttcatactttgccctgatagcagcaggggctgcacatcccaacctcttttcagcttagctcaccataaaaagcgggatcagagatctacttctcagctctttctgatttcccccagggaagttacaaaagaatgacaaaaacttggagaaggcagatatcattagtattaaagagaactggaggtttagggggaaataaagctgaataaaaaacagcagggctggctgagcgtggtggctcacgcctgtcatctcagcgctctgggaggctgaggtgggtggatcatttgaaatcagaagttcgagaccagcttggccaacatggcgaaaccccatttctactaaaaatacaaaaattagccgggcgtggtggcgggtgcctgtagttccagctactcagaaggctgaggcaggagaatcgcttgaacccgggtggtggaagttgcagtgagccaagatcacactactgcactccagtctgggtgacggaacaagactccatctcaaaaaaacaaaacaaaacagggcctatgcatccctgagatgtgaagcagggggagataagggatttagatgtatatcctactaggtttttgctgtgttctgccatgcagttgtctgggcaggatttatttatattttaatttatttcaggggccatgctaatcatctttgtattgttccaattttagtgtatgtgctgctgaagcaagcactgggtaaggtttaaactgtctagttctgtgtgctggggtttggcattggagaaggctctgtgatgcatagaccttaaattagagttaggtatattattaatccaaagtgatcctgaatgctttctatcatttttttcttgtcctattgcactggctaaactgacttttagtactacacagaatagaagcaacaataacaatcatccttgtcttgttcctaactttagtggactatttacaatattttactgagttagatgccttaggttccacgtagctgctctttatgaaagacctcactgggttacccttcagtcttggaggagtctgggtattggccatgacatttgccatgaatgatggagttctctctgccaggtcctcatgccctggagctgtacggctgcacttcagctgctgcacatttgactttttgagtagcccttgaatctctgctcttccttggcctctctatagtttttggtataatagcctcagcttaagtttgagttttgtaggaaaacaatgggcctgtgctgacaaagatacaaagtcaaggaacaggattttttatatctcaactaacttggtcctagctttgacatttacttgccatataacaatggatgaataacagtctctttaagccttagtttcatccaccgtgaaatgggaaaaataatatctgtttcatagagttgttttaggatcatgtaacttatgtaaaacactgaatagttttccaggcatgatataggcactcaatctcatattatgaataagcttatgatgcatgggggatactgatgacagctttcttctgtccaggcaggcccagctacatggtggtatgaccagtgcagtcacacagccccatgcttagcagggctctgcacttagtttaatgctctgctgttgccatcttgaagttcttaatttttaaacaagcatcccatattttgcactgtttcttgcaaacagtgtagccagttctgtctccaggaatggatccagcactagtactggcccttctctttgggaaacatccttccattgatttcttagggagtaaatcccttgaagagtaacctcccatagaaaaattagggttagcaccctgtgtatgtttatctctaactgttccattctcagtaacctacacatcctctctcattaaaaaaacaaaacaaaacaaaaaacactttatattttacagaagctattagatccagagaggttggtaggggtgctggtgaaatggaatggtgatttgggattttggaatcaggaaaaagatctaagttcaaaaccctgctagtccctttctggccgagttacttggacaaggtaatgtctctgtcctactggtaaagtgtatgttgcaggggaattacattctttgttggtaaaatatatgcctcaggggaattaaacagataatttatgtaaagtgcctttcacagagagtctggcacatagtaggtggtcggtcactattaattcttccagctcttgccagaaataactaaaatcagggcactaggacttccaagccgtgctgctactaataaaagaaataatatgatttattttttcacaactgtttggggaaaggcctgtgcttcataaatatgcgttggaaagtacttagcaaatgagtagaaataataaaaatatgtccaagtaaacagctcctataaa

SEQ ID NO: 173566 - DNA, 2287 bp, Homo sapiens
  Payload ID: 14094
  Gene Symbol: RAD51D
  Gene Name: RAD51 paralog D
  Uniprot ID: O75771
  ENST ID: ENST00000394589
  CDS Start-End: 140-1126
cggtgtgtgtgttgcggcagaagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacagaaa

SEQ ID NO: 173567 - DNA, 1064 bp, Homo sapiens
  Payload ID: 14094
  Gene Symbol: RAD51D
  Gene Name: RAD51 paralog D
  ENST ID: ENST00000460118
  CDS Start-End: 483-938
tttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaagtcttgataaactgcttgatgctggtctctatactggagaagtgactgaaattgtaggaggcccaggtagcggcaaaactcagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaaga

SEQ ID NO: 173568 - DNA, 603 bp, Homo sapiens
  Payload ID: 14094
  Gene Symbol: RAD51D
  Gene Name: RAD51 paralog D
  ENST ID: ENST00000585343
  CDS Start-End: 1-260
ctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttga

SEQ ID NO: 173569 - DNA, 561 bp, Homo sapiens
  Payload ID: 14094
  Gene Symbol: RAD51D
  Gene Name: RAD51 paralog D
  ENST ID: ENST00000590631
  CDS Start-End: 488-561
acaggatcaagacaggtgaccgggtgtgcgcgtgccagggagccgcgcgggcctcgcacaacctgggcaggccccgagggctggcgcactgccctggcatacctgcagggcgcttcccctccattcctagagggccgcgcttctggagaggctcaggaagggtgggcgtggggagccaagctctaaaacagggtagagattcctactgtgtgcagggcaccgcgccggctcctgcagctttgttatttcacactggcctcctgagacggcctgccggggggtagaattgacaccccatttgacagatgaggaaaaaccaagtgtgggaggccccagtcctctctgccaatccgctatacgtgttttgttttcagtggtggacctggtttctgcagacctggaagaggtagctcagaaatgtggcttgtcttacaaggcagaagctctccggaggatccaggtggtgcatgcatttgacatcttccagatgctggatgtgctgcaggagctccgaggcactgtggcccagcaggtgactggttcttcaggaactgtgaaggt

SEQ ID NO: 173570 - DNA, 1409 bp, Homo sapiens
  Payload ID: 14094
  Gene Symbol: RAD51D
  Gene Name: RAD51 paralog D
  Uniprot ID: O75771
  ENST ID: ENST00000588594
  CDS Start-End: 107-256
tgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaagtcttgataaactgcttgatgctggtctctatactggagaagtgactgaaattgtaggaggcccaggtagcggcaaaactcaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccg

SEQ ID NO: 173571 - DNA, 1571 bp, Homo sapiens
  Payload ID: 14094
  Gene Symbol: RAD51D
  Gene Name: RAD51 paralog D
  Uniprot ID: O75771
  ENST ID: ENST00000586044
  CDS Start-End: 134-283
cctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccg

SEQ ID NO: 173572 - DNA, 1194 bp, Homo sapiens
  Payload ID: 14094
  Gene Symbol: RAD51D
  Gene Name: RAD51 paralog D
  ENST ID: ENST00000586210
  CDS Start-End: 104-427
gtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagagga

SEQ ID NO: 173573 - DNA, 1528 bp, Homo sapiens
  Payload ID: 14094
  Gene Symbol: RAD51D
  Gene Name: RAD51 paralog D
  Uniprot ID: O75771
  ENST ID: ENST00000590016
  CDS Start-End: 201-1247
aatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccct

SEQ ID NO: 173574 - DNA, 676 bp, Homo sapiens
  Payload ID: 14094
  Gene Symbol: RAD51D
  Gene Name: RAD51 paralog D
  ENST ID: ENST00000587405
  CDS Start-End: 254-676
tcatgagaggggtaaaaccaaggaacagactgcatgagcccttgggccccttccagctctaatactccatggtgatggcagccctgcccttctctgaagatctcaaaatgcctgacacctgtgtccttccgcactgccctgggaaggagaataaggatgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctc

SEQ ID NO: 173575 - DNA, 1732 bp, Homo sapiens
  Payload ID: 14094
  Gene Symbol: RAD51D
  Gene Name: RAD51 paralog D
  Uniprot ID: O75771
  ENST ID: ENST00000587977
  CDS Start-End: 226-582
ccggcgggcgggctctgggcgcgggaatcccggcggatcccgggcgggcggatgacccccagccctacccttggtgccgcctcctcctctctcctttctcctccggcagccagcgcgcctgtgtcctctctaggaaggggtaggggaggggcgtctggagaggaccccccgcgaatgcccacgtgacgtgcagtccccctggggctgttccggcctgcggggaacatgggcgtgctcagggtcggactgtgccctggccttaccgaggagatgatccagcttctcaggagccacaggatcaagacagtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgcctttttttt

SEQ ID NO: 173576 - DNA, 762 bp, Homo sapiens
  Payload ID: 14094
  Gene Symbol: RAD51D
  Gene Name: RAD51 paralog D
  ENST ID: ENST00000592577
  CDS Start-End: 15-762
tcccgggcgggcggatgacccccagccctacccttggtgccgcctcctcctctctcctttctcctccggcagccagcgcgcctgtgtcctctctaggaagggtggtggacctggtttctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtga

SEQ ID NO: 173577 - DNA, 289 bp, Homo sapiens
  Payload ID: 14094
  Gene Symbol: RAD51D
  Gene Name: RAD51 paralog D
  ENST ID: ENST00000586186
  CDS Start-End: 1-289
ctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagtcttgataaactgcttgatgctggtctctatactggagaagtgactgaaattgtaggaggcccaggtagcggcaaaactcaggcagaagctctccggaggatccaggtggtgcatgcatttga

SEQ ID NO: 173578 - DNA, 386 bp, Homo sapiens
  Payload ID: 14094
  Gene Symbol: RAD51D
  Gene Name: RAD51 paralog D
  ENST ID: ENST00000592850
  CDS Start-End: 1-260
ctgcagacctggaagaggtagctcagaaatgtggcttgtcttacaaggccctggttgccctgaggcgggtgctgctggctcagttctcggctttccccgtgaatggcgctgatctctacgaggaactgaagacctccactgccatcctgtccactggcattggcagacatggagggcgcactcaagtgggaacctgggaggactgcagctgcctcaggtccccgcagggagatcgtggagtggggtcaggaatgctctgaagaaggcaggacttgggcatggaggaacagatggactttcgctgaatgctttcgatgaacgaggcactgcggtcagcacttcacggcagaagctctccggaggatccaggtggtgcatgcatttga

SEQ ID NO: 173579 - DNA, 2214 bp, Homo sapiens
  Payload ID: 14094
  Gene Symbol: RAD51D
  Gene Name: RAD51 paralog D
  ENST ID: ENST00000588372
  CDS Start-End: 302-583
agctatgtggctggccagaccaagggccagtgtgactgtgaagcagcatcatgagaggggtaaaaccaaggaacagactgcatgagcccttgggccccttccagctctaatactccatggtgatggcagccctgcccttctctgaagatctcaaaatgcctgacacctgtgtccttccgcactgccctgggaaggagaataaggatgtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggatggaattcccgagcacctaaatcacatacctcattgtttacatgttcatcttccctgctgaacagtaaagccccctgagtggaaggatcatgtcatatttatgtctgcattccccactaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagccaacaggtttccaggagatggtagacattgggacctgggggacctcagagcagagtgccacattacagggtgatcagacatgacctgtgctgttgtttgggaaacagggaagcattggggacccctcccaacttttcttcccagtaacgcctgctgtttactgccacctggcactggtgactacagacgttctcaggctggccagaagagacatcttgggttccttggcctcactctctgtaagcatataaaccacaggcgaaagaggatgctgcattgcgaggacccagaaattcatactggtgccacgtttccttcccttatttctaacgtgtatgtttctggtggaaaccaagttcaccctggctgggagcatctctgatgaggcatgctggcgactggatggataatcctgtgcatcaccattgtgtcctgtgctccctcctagcgcagtggccaagccgggaaagcctctaacttgcctttgctgctgctgccttttttttcttttgtctctgcctttccatttgttagatgggggcccactcttccttagctctgtctctgagttactgggtggaaataagcttataaatgaaatactcttcttcatctctgttttgctcttaaaaatataaaaaggcaattccccgagccctagagccacctgatttccccttagaaggctgtttttcagtttcccccagtgaggcccaaagaacagtttattcctcctttcctcttgctgatttggtttcagacctgcctgcatcaccatgactaggtgagaacgtgtgggctcgctgcagttccagggatataatttaacagaaagggagggtatgacctgctcctggtgaatccagccactcatttaatatgcatggtgccctgtggggcccctccacagtacagcataaccagaggtgctgaaccatggccttgcccataaacagacagaggagaatttgcacagtaaatagagccagctgggaaaattgatgctgacgtaaataatacatggcaaatctagtcctttatgcagaaattcattgctggtggctccaagatgcaatataattacacctctcttcctgccagctgtaccacagctagtgccctagtgtatgaaataatccctctgtctttcaccagcactgtggccatccgtctgagagccatgaccctggctgggaggggacgaagacaccagggaatggaaaataaaaggaaaagtacagaaa

SEQ ID NO: 173580 - DNA, 2449 bp, Homo sapiens
  Payload ID: 14095
  Gene Symbol: RAD51
  Gene Name: RAD51 recombinase
  Uniprot ID: Q06609
  ENST ID: ENST00000267868
  CDS Start-End: 269-1288
gagggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagggaatgggtctgcacagattctttttttctgtcagtaaaactctcaagcaggtttttaagttgtctgtctgaatgatcttgtgtaaggttttggttatggagtcttgtgccaaacctactaggccattagcccttcaccatctacctgcttggtctttcattgctaagactaactcaagataatcctagagtcttaaagcatttcaggccagtgtggtgtcttgcgcctgtactcccagcactttgggaggccgaggcaggtggatcgcttgagcccaggagttttaagtccagcttggccaaggtggtgaaatcccatctctacaaaaaatgcagaacttaatctggacacactgttacacgtgcctgtagtcccagctactcgatagcctgaggtgggagaatcacttaagcctggaaggtggaagttgcagtgagtcgagattgcactgctgcattccagccagggtgacagagtgagaccatgtttcaaacaagaaacatttcagagggtaagtaaacagatttgattgtgaggcttctaataaagtagttattagtagtgaatgtgctgtttatagcaattattgcagtgcaagctatttcaagacagggtttccataatctttttggcactgtataggggtgatcagtttctgttgcttcaagatttgaaaccagaaaggaaagtcccacttgcagatgattgtgcttaaaagctaatggaaaaataaaagaaagacatacc

SEQ ID NO: 173581 - DNA, 1588 bp, Homo sapiens
  Payload ID: 14095
  Gene Symbol: RAD51
  Gene Name: RAD51 recombinase
  Uniprot ID: Q06609
  ENST ID: ENST00000382643
  CDS Start-End: 151-1173
aattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagctaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctgacggagtctcgctctgttgccaggctggagtgcaatagcgtgatcttggtctactgcaccctccgcctctcaggttcaagtgattctcctgcctcagcctcccgagtagttgggactacaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaaggg

SEQ ID NO: 173582 - DNA, 1611 bp, Homo sapiens
  Payload ID: 14095
  Gene Symbol: RAD51
  Gene Name: RAD51 recombinase
  Uniprot ID: Q06609
  ENST ID: ENST00000423169
  CDS Start-End: 300-1142
gttacgtcgacgcgggcgtgaccctgggcgagagggtttggcgggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaagg

SEQ ID NO: 173583 - DNA, 1545 bp, Homo sapiens
  Payload ID: 14095
  Gene Symbol: RAD51
  Gene Name: RAD51 recombinase
  ENST ID: ENST00000525066
  CDS Start-End: 242-697
gctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaa

SEQ ID NO: 173584 - DNA, 625 bp, Homo sapiens
  Payload ID: 14095
  Gene Symbol: RAD51
  Gene Name: RAD51 recombinase
  ENST ID: ENST00000526763
  CDS Start-End: 401-625
gcggctcgtcctcgcccacctgcgtcctggccggtccagtgctcagcggcagttggggcctccgcgcgcagtgtgaaacccggacgtggcagggcgtgtccgcgcccgaccgaccctcagctgctggggcgaaaacacaagtggacctcagtctttagaactaggggagaaacattagagcctttataggcaacacctattttatgggttcgagcgagaagtccgagatcagagcggtgtagccacagctgtttaatatcacagccagggcttccggattcctgatctgtctttccattacaccgtgcttagaaagtaccaatctccgattgccaaaacagtgttttcatcatctaatgcggaaaaccattcacatgatgcctagagaatgatctgaataatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctg

SEQ ID NO: 173585 - DNA, 566 bp, Homo sapiens
  Payload ID: 14095
  Gene Symbol: RAD51
  Gene Name: RAD51 recombinase
  ENST ID: ENST00000527860
  CDS Start-End: 50-566
cttgggagtcgtggtcttcgatctggtaaacagaagacggcaactcgtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctgg

SEQ ID NO: 173586 - DNA, 425 bp, Homo sapiens
  Payload ID: 14095
  Gene Symbol: RAD51
  Gene Name: RAD51 recombinase
  ENST ID: ENST00000533741
  CDS Start-End: 1-197
ttgcctatgcgccaaagaaggagctaataaatattaagggaattagtgaagccaaagctgataaaattctgacggagtctcgctctgttgccaggctggagtgcaatagcgtgatcttggtctactgcaccctccgcctctcaggttcaagtgattctcctgcctcagcctcccgagtagttgggactacaggctgaggcagctaaattagttccaatgggtttcaccactgcaactgaattccaccaaaggcggtcagagatcatacagattactactggctccaaagagcttgacaaactacttcaaggtggaattgagactggatctatcacagaaatgtttggagaattccgaactgggaagacccagatctgtcatacgctagctgtcacctgccagcttcccattgaccggggtggagg

SEQ ID NO: 173587 - DNA, 1515 bp, Homo sapiens
  Payload ID: 14095
  Gene Symbol: RAD51
  Gene Name: RAD51 recombinase
  Uniprot ID: Q06609
  ENST ID: ENST00000532743
  CDS Start-End: 255-1277
aattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctgacggagtctcgctctgttgccaggctggagtgcaatagcgtgatcttggtctactgcaccctccgcctctcaggttcaagtgattctcctgcctcagcctcccgagtagttgggactacaggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttgg

SEQ ID NO: 173588 - DNA, 658 bp, Homo sapiens
  Payload ID: 14095
  Gene Symbol: RAD51
  Gene Name: RAD51 recombinase
  ENST ID: ENST00000531277
  CDS Start-End: 3-305
taatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggtggaattgagactggatctatcacagaaatgtttggagaattccgaactgggaagacccagatctgtcatacgctagctgtcacctgccagcttcccattgaccggggtggaggtgaaggaaaggccatgtacattgacactgagggtacctttaggccagaacggctgctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgag

SEQ ID NO: 173589 - DNA, 1397 bp, Homo sapiens
  Payload ID: 14095
  Gene Symbol: RAD51
  Gene Name: RAD51 recombinase
  Uniprot ID: Q06609
  ENST ID: ENST00000557850
  CDS Start-End: 257-985
ggaattctgaaagccgctggcggaccgcgcgcagcggccagagaccgagccctaaggagagtgcggcgcttcccgaggcgtgcagctgggaactgcaactcatctgggttgtgcgcagaaggctggggcaagcgagtagagaagtggagcgtaagccaggggcgttgggggccgtgcgggtcgggcgcgtgccacgcccgcggggtgaagtcggagcgcggggcctgctggagagaggagcgctgcggaccgagtaatggcaatgcagatgcagcttgaagcaaatgcagatacttcagtggaagaagaaagctttggcccacaacccatttcacggttagagcagtgtggcataaatgccaacgatgtgaagaaattggaagaagctggattccatactgtggaggctgttgcctatgcgccaaagaaggagctaataaatattaagggaattagtgaagccaaagctgataaaattctggcagtggctgagaggtatggtctctctggcagtgatgtcctggataatgtagcatatgctcgagcgttcaacacagaccaccagacccagctcctttatcaagcatcagccatgatggtagaatctaggtatgcactgcttattgtagacagtgccaccgccctttacagaacagactactcgggtcgaggtgagctttcagccaggcagatgcacttggccaggtttctgcggatgcttctgcgactcgctgatgagtttggtgtagcagtggtaatcactaatcaggtggtagctcaagtggatggagcagcgatgtttgctgctgatcccaaaaaacctattggaggaaatatcatcgcccatgcatcaacaaccagattgtatctgaggaaaggaagaggggaaaccagaatctgcaaaatctacgactctccctgtcttcctgaagctgaagctatgttcgccattaatgcagatggagtgggagatgccaaagactgaatcattgggtttttcctctgttaaaaaccttaagtgctgcagcctaatgagagtgcactgctccctggggttctctacaggcctcttcctgttgtgactgccaggataaagcttccgggaaaacagctattatatcagcttttctgatggtataaacaggagacaggtcagtagtcacaaactgatctaaaatgtttattccttctgtagtgtattaatctctgtgtgttttctttggttttggaggaggggtatgaagtatctttgacatggtgccttaggaatgacttgggtttaacaagctgtctactggacaatcttatgtttccaagagaactaaagctggagagacctgacccttctctcacttctaaattaatggtaaaataaaatgcctcagctatgtagcaaa

SEQ ID NO: 173590 - DNA, 787 bp, Homo sapiens
  Payload ID: 14096
  Gene Symbol:
  Gene Name: RAD51L3-RFFL
  ENST ID: ENST00000592181
  CDS Start-End: 176-787
acagaaggctctttagaagtggtggacctggtttctgcagacctggaagaggtagctcagaaatgtggcttgtcttacaagtcttgataaactgcttgatgctggtctctatactggagaagtgactgaaattgtaggaggcccaggtagcggcaaaactcaggtatgtctctgtatggcagcaaatgtggcccatggcctgcagcaaaacgtcctatatgtagattccaatggagggctgacagcttcccgcctcctccagctgcttcaggctaaaacccaggatgaggaggaacaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagattttatcatgtgggcaacctgctgcaactggttctgcctggatggacagcctgaggaggtcccac

SEQ ID NO: 173591 - DNA, 1638 bp, Homo sapiens
  Payload ID: 14096
  Gene Symbol:
  Gene Name: RAD51L3-RFFL
  ENST ID: ENST00000593039
  CDS Start-End: 201-1019
atgtggctggccagaccaagggccagtgtgactgtgaagcagcatcatgagaggggtaaaaccaaggaacagactgcatgagcccttgggccccttccagctctaatactccatggtgatggcagccctgcccttctctgaagatctcaaaatgcctgacacctgtgtccttccgcactgccctgggaaggagaataaggatggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagtctattgactcagaggacagctttgtcccaggccgaagggcctctctgtctgacctgactgacctggaggacattgaaggcctgacagtgcggcagctgaaagagatcttggctcgcaactttgtcaactacaagggctgctgtgagaagtgggagctgatggagagagtgacccggctatacaaggatcagaaaggactccagcacctggggggagcagtaccatcaggcttggaggagaacctgtgtaagatctgcatggactcacccattgactgtgttcttctggagtgtggccacatggtaacctgtaccaagtgtggcaagcgcatgaatgaatgtcccatctgccggcagtatgtaatccgagctgtgcatgtcttccggtcctgagagcttgcatcggtttcttcagtgccttacagggaaatagcctggggtgtctgggctcagggttggccagcttgcagaggagcaagctagtagaaatattgcagggttcccaaaaccaggtcaagcaagatgccatgtcacccctgagcatgcctgtcttcccaggggtgtacctcttggctggcaaagcccaaggccagtgggaacttgtataaatcacatgggtatgttcttggttcagtgatcttggagtgatgatggtaactgatgaacagagaactttccagaacttgggtcctgtcttcctccctgaacctagacagtttcacccctcctcctgtacccaacccatccccaccccatatgggagatgcttgcccatgtgtttcatcaatcagaagtcctcctccccagcacattcggatttaaatttctggtctctccggctttctgtgctttaactatctttgctaaagtctcttgctacattgcctaaatccatttgtttctttggaccaaaaatgttagtttaccagaccgatagtggtccttaggacagattttagaccagtaaacttatctttggtgagaaatgaaatacaaatgctatagaaaaatt

SEQ ID NO: 173592 - DNA, 676 bp, Homo sapiens
  Payload ID: 14096
  Gene Symbol:
  Gene Name: RAD51L3-RFFL
  ENST ID: ENST00000591723
  CDS Start-End: 293-676
tcatgagaggggtaaaaccaaggaacagactgcatgagcccttgggccccttccagctctaatactccatggtgatggcagccctgcccttctctgaagatctcaaaatgcctgacacctgtgtccttccgcactgccctgggaaggagaataaggatgtcttgataaactgcttgatgctggtctctatactggagaagtgactgaaattgtaggaggcccaggtagcggcaaaactcaggcagaagctctccggaggatccaggtggtgcatgcatttgacatcttccagatgctggatgtgctgcaggagctccgaggcactgtggcccagcaggtgactggttcttcaggaactgtgaaggtggtggttgtggactcggtcactgcggtggtttccccacttctgggaggtcagcagagggaaggcttggccttgatgatgcagctggcccgagagctgaagaccctggcccgggaccttggcatggcagtggtggtgaccaaccacataactcgagacagggacagcgggaggctcaaacctgccctcggacgctcctggagctttgtgcccagcactcggattctcctggacaccatcgagggagcaggagcatcaggcggccggcgcatggcgtgtctggccaaatcttcccgacagtctattgactca

SEQ ID NO: 173593 - DNA, 2710 bp, Homo sapiens
  Payload ID: 14097
  Gene Symbol: RAD52
  Gene Name: RAD52 homolog, DNA repair protein
  Uniprot ID: P43351
  ENST ID: ENST00000358495
  CDS Start-End: 140-1396
ttcccagagacgctcgcgcacccttcccattctcctctgcgcggcctccatctaagatctcttccccttgtccatagcctagatcgagctccctgtgtgcaccgcgcgctgcccgaggcgcaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtgagggcctcaagtccaaggctttatctttggagaaggcaaggaaggaggcggtgacagacgggctgaagcgagccctcaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatattgcttatctgaaatgcttgaaaccagaattgttttgcattttttgaatatttgtatacacataatgagaccttggggatgggacccaagtctgaacgtggaattcacctgtgtttcgtgtatatgcctcatacacataattttgtgcatgaaacagagtttttgtataagaagatacactgcagctgaagagggctgggtttttttttctcttagggtcgctgcataaactgttgtatgcctggtgctttgcgacttgtcacacgaggtcacgtgtggaattttccacttctggcatcacgtcagtgctcagaaattttctgatctcagagcatttcaattagggatgctcaaacgcaactgtttctacttccccatttcaggtgtgagatgtaacccaccttgaccataaattggcttttcatagtgctcagatgtttc

SEQ ID NO: 173594 - DNA, 530 bp, Homo sapiens
  Payload ID: 14097
  Gene Symbol: RAD52
  Gene Name: RAD52 homolog, DNA repair protein
  ENST ID: ENST00000397230
  CDS Start-End: 136-530
agaacctggggctgcggtggacctgatcctgaggtctcagcgtagagatgctgagtccagaggcctgttctagttcaccagtgcagtgaggggctcagtatccgggcctcccgagagaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggtgaggggatggagtagacctgctgcccggaaggatcagtgggtggt

SEQ ID NO: 173595 - DNA, 2366 bp, Homo sapiens
  Payload ID: 14097
  Gene Symbol: RAD52
  Gene Name: RAD52 homolog, DNA repair protein
  Uniprot ID: P43351
  ENST ID: ENST00000430095
  CDS Start-End: 264-1520
gttccctcccaggatcgacatgcacttggatcattgcagtttctgggcctgctgtcatctcccccttcagtacttcccacatatgactaccaactgttagacgatgtgctgctgccagaccagcctttcatttcttggacatccggctatttacccaggaaaagtcatcctttgactatttttcatgacctttctcatctgactcgtgatctgcccatcttgttactccctagcagtgtggtaagaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtgagggcctcaagtccaaggctttatctttggagaaggcaaggaaggaggcggtgacagacgggctgaagcgagccctcaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtatacc

SEQ ID NO: 173596 - DNA, 2499 bp, Homo sapiens
  Payload ID: 14097
  Gene Symbol: RAD52
  Gene Name: RAD52 homolog, DNA repair protein
  Uniprot ID: P43351
  ENST ID: ENST00000468231
  CDS Start-End: 135-554
gatcgagctccctgtgtgcaccgcgcgctgcccgaggcgccccagtgacagctggagtggacaaagtgaccaagggcctcaaggacacacaaggccaagaagatttgaagtgctgtaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggtgaggggatggagtagacctgctgcccggaaggatcagtgggtggtaggagaaggatggttcatatcatgaagatgttggttatggtgttagtgagggcctcaagtccaaggctttatctttggagaaggcaaggaaggaggcggtgacagacgggctgaagcgagccctcaggcttcccttgctgggagtaagtggtagaatcctgtactctctcttctccgtgcactcagtcatgtgtgccggaggccttcccactcctactgcgagtgcacagacagcaccctcctctccgtgctcctcagcagtcctccgctacgcacaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggaaactgggaatctcataggaagagccaggacatgaagaaaaggaaatatgatccatcttaactgaggctcaggccacataattggactctgtcacaaagggactttggaaaactactttttggtcatgaaattgttcatcgctgctggagaatgaacgtcattgcgatttatcttgcttcattctgaaccttatcaagaggatctgactgagagcccactgcagttagagctgagcacttttgaaaagcttgtccatcactctagtagggagaggctctggacagatgaataccttttcttcggcttgtgaggcttcccactatttattactgaactattatgttaatgaagatggacattttaggaatcaccaatggctccttgccctcaagcaatataggccagacttggtcctaagcacctgcctcagcaattgtctacattcagttgttttgcataacgtctgccttctttcctttacggtccatgcctttaatgttgcccacattaagcactgtggatcacgacaggaaaaaggttggagcagtgcttttcactactttgtatcaatccaggctacaatcttcatttaatataaataatttatggatttatgacattacaatcctgcattgtttcaagactgacattttttcctaaggaaggaaataatcatctaagaccacgaaaaaaggctgttttttgtttttttttttttttttttttttgagacggggtctggctgtgttgccctgactggagttcagtggtgcaaacacagctctctccacaacctcttgggcccaagtgatactcccacctctgccttacaaaatacagggattactggtgtgagccactgtgtctggccagaaaaggcatttttgagaaagcaaatcgtataccttattaacaaaatagaatatatatatattgcttatctgaaatgcttgaaaccagaa

SEQ ID NO: 173597 - DNA, 1531 bp, Homo sapiens
  Payload ID: 14097
  Gene Symbol: RAD52
  Gene Name: RAD52 homolog, DNA repair protein
  Uniprot ID: P43351
  ENST ID: ENST00000461568
  CDS Start-End: 79-498
tctcttccccttgtccatagcctagatcgagctccctgtgtgcaccgcgcgctgcccgagaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggtgaggggatggagtagacctgctgcccggaaggatcagtgggtggtaggagaaggatggttcatatcatgaagatgttggttatggtgttagtgagggcctcaagtccaaggctttatctttggagaaggcaaggaaggaggcggtgacagacgggctgaagcgagccctcaggcttcccttgctgggagtaagtggtagaatcctgtactctctcttctccgtgcactcagtcatgtgtgccggaggccttcccactcctactgcgagtgcacagacagcaccctcctctccgtgctcctcagcagtcctccgctacgcacaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgcagccgcggctgttgctcaggagcccgtcctcgccgccgccctctcatgcagaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacag

SEQ ID NO: 173598 - DNA, 560 bp, Homo sapiens
  Payload ID: 14097
  Gene Symbol: RAD52
  Gene Name: RAD52 homolog, DNA repair protein
  Uniprot ID: P43351
  ENST ID: ENST00000541619
  CDS Start-End: 167-523
atctaagatctcttccccttgtccatagcctagatcgagctccctgtgtgcaccgcgcgctgcccgaggcgccccagtgacagctggagtggacaaagtgaccaagggcctcaaggacacacaaggccaagaagatttgaagtgctgtaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtgggtgagtatgctctccagcagtggggacttctgcactgtccagctcctgctgaaagtctgctgtgggtgaggaggtaaggtaggtggactcagctgccagcaggaggaatggttg

SEQ ID NO: 173599 - DNA, 1243 bp, Homo sapiens
  Payload ID: 14097
  Gene Symbol: RAD52
  Gene Name: RAD52 homolog, DNA repair protein
  ENST ID: ENST00000543912
  CDS Start-End: 83-382
tctcttccccttgtccatagcctagatcgagctccctgtgtgcaccgcgcgctgcccgaggcgcaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtgggcttcccttgctgggagtaagtggtagaatcctgtactctctcttctccgtgcactcagtcatgtgtgccggaggccttcccactcctactgcgagtgcacagacagcaccctcctctccgtgctcctcagcagtcctccgctacgcacaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacaggt

SEQ ID NO: 173600 - DNA, 681 bp, Homo sapiens
  Payload ID: 14097
  Gene Symbol: RAD52
  Gene Name: RAD52 homolog, DNA repair protein
  Uniprot ID: P43351
  ENST ID: ENST00000545564
  CDS Start-End: 1-681
atgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtgagggcctcaagtccaaggctttatctttggagaaggcaaggaaggaggcggtgacagacgggctgaagcgagccctcaggcttcccttgctgggagtaagtggtagaatcctgtactctctcttctccgtgcactcagtcatgtgtgccggaggccttcccactcctactgcgagtgcacagacagcaccctcctctccgtgctcctcagcagtcctccgctacgcacaggagttttgggaatgcacttggaaactgtattctggacaaagactacctgagatcactaaataa

SEQ ID NO: 173601 - DNA, 1139 bp, Homo sapiens
  Payload ID: 14097
  Gene Symbol: RAD52
  Gene Name: RAD52 homolog, DNA repair protein
  ENST ID: ENST00000536177
  CDS Start-End: 85-990
gatctcttccccttgtccatagcctagatcgagctccctgtgtgcaccgcgcgctgcccgaggcgcaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtgagggcctcaagtccaaggctttatctttggagaaggcaaggaaggaggcggtgacagacgggctgaagcgagccctcaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgcagccgcggctgttgctcaggagcccgtcctcgccgccgccctctcatgcagaagcctgagctcatccgccgtggagagcgaggccacgcaccagcggaagctccggcagaagcagctgcagcagcagttccgggagcggatggagaagcagcaggttcgagtctccacgccgtcagctgagaagagtgagggtgagcgaggggtgggagcagggccctgggaggcgtctgcaggaggaagtgtagccgcagggtcttctgattctctgcggtaaccctgggccggctccaaaccaggcctcgctgggacttctctcaagctacacgcag

SEQ ID NO: 173602 - DNA, 633 bp, Homo sapiens
  Payload ID: 14097
  Gene Symbol: RAD52
  Gene Name: RAD52 homolog, DNA repair protein
  ENST ID: ENST00000542785
  CDS Start-End: 245-633
gtgtgcaccgcgcgctgcccgaggcgcgtaagtgggggaggagagcggcttcccccggggtggttctagccgtgggtgtggagcgtgggaaggctcagcttccgggtcgagaacctggggctgcggtggacctgatcctgaggtctcagcgtagagatgctgagtccagaggcctgttctagttcaccagtgcagtgaggggctcagtatccgggcctcccgagagaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggatggttcatatcatgaagatgttggttatggtgttagtga

SEQ ID NO: 173603 - DNA, 463 bp, Homo sapiens
  Payload ID: 14097
  Gene Symbol: RAD52
  Gene Name: RAD52 homolog, DNA repair protein
  Uniprot ID: P43351
  ENST ID: ENST00000544742
  CDS Start-End: 63-419
atagcctagatcgagctccctgtgtgcaccgcgcgctgcccgagaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtgggtgagtatgctctccagcagtggggacttctgcactgtccagctcctgctgaaagtctgctgtgggtgaggaggtaaggtaggtggactcagctgccagcaggaggaatggttgtggccca

SEQ ID NO: 173604 - DNA, 1530 bp, Homo sapiens
  Payload ID: 14097
  Gene Symbol: RAD52
  Gene Name: RAD52 homolog, DNA repair protein
  ENST ID: ENST00000539046
  CDS Start-End: 79-441
tctcttccccttgtccatagcctagatcgagctccctgtgtgcaccgcgcgctgcccgagaggtcaaccagaatcaagatgtctgggactgaggaagcaattcttggaggacgtgacagccatcctgctgctggcggcggctcagtgttatgctttggacagtgccagtacacagcagaagagtaccaggccatccagaaggccctgaggcagaggctgggcccagaatacataagtagccgcatggctggcggaggccagaaggtgtgctacattgagggtcatcgggtaattaatctggccaatgagatgtttggttacaatggctgggcacactccatcacgcagcagaatgtggattttgttgacctcaacaatggcaagttctacgtgggagtctgtgcatttgtgagggtccagctgaaggtgaggatggagtagacctgctgcccggaaggatcagtgggtggtaggagaaggatggttcatatcatgaagatgttggttatggtgttagtgagggcctcaagtccaaggctttatctttggagaaggcaaggaaggaggcggtgacagacgggctgaagcgagccctcaggcttcccttgctgggagtaagtggtagaatcctgtactctctcttctccgtgcactcagtcatgtgtgccggaggccttcccactcctactgcgagtgcacagacagcaccctcctctccgtgctcctcagcagtcctccgctacgcacaggagttttgggaatgcacttggaaactgtattctggacaaagactacctgagatcactaaataagcttccacgccagttgcctcttgaagtggatttaactaaagcgaagagacaagatcttgaaccgtctgtggaggaggcaagatacaacagctgccgaccgaacatggccctgggacacccacagctgcagcaggtgacctccccttccagacccagccatgctgtgataccggcggaccaggactgcagctcccgcagccgcggctgttgctcaggagcccgtcctcgccgccgccctctcatgcagaagcctgagctcatccgccgtggagagcgaggccacgcaccagcggaagctccggcagaagcagctgcagcagcagttccgggagcggatggagaagcagcaggttcgagtctccacgccgtcagctgagaagagtgaggcagcgcctccggcccctcctgtgacgcacagcactcctgtaactgtctcagaaccactcctggagaaagacttccttgcaggagtgactcaagaattaatcaagactcttgaagacaactctgaaaagtgggctgtgactcccgatgcaggggatggtgtggtcaagccctcgtctagagcagacccagcccagacctctgacacattagccttgaacaaccagatggtgacccagaacaggactccacacagcgtttgccaccagaaaccacaagcaaaatctggatcttgggacctccaaacttatagcgctgaccaacgcacaacagg

SEQ ID NO: 173605 - DNA, 587 bp, Homo sapiens
  Payload ID: 14098
  Gene Symbol: RDM1
  Gene Name: RAD52 motif containing 1
  Uniprot ID: Q8NG50
  ENST ID: ENST00000615288
  CDS Start-End: 1-414
atggcggagttggtaccttttgcggttcccatcgagagtgacaaaaccttgctagtgtgggagctgagctccggacccacggccgaggctttgcatcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactag

SEQ ID NO: 173606 - DNA, 518 bp, Homo sapiens
  Payload ID: 14098
  Gene Symbol: RDM1
  Gene Name: RAD52 motif containing 1
  Uniprot ID: Q8NG50
  ENST ID: ENST00000618511
  CDS Start-End: 1-345
atgcatttacttgtcccacccccacagcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactag

SEQ ID NO: 173607 - DNA, 506 bp, Homo sapiens
  Payload ID: 14098
  Gene Symbol: RDM1
  Gene Name: RAD52 motif containing 1
  Uniprot ID: Q8NG50
  ENST ID: ENST00000619368
  CDS Start-End: 1-240
atggcggagttggtaccttttgcggttcccatcgagagtgacaaaaccttgctagtgtgggagctgagctccggacccacggccgaggctttgcatgttcgtcttggcaccagacataaggcagttcaacatcaagcccttgccctgaacagttccaaatgccaagaactggcgaattactactttggtttcaatgggtgttccaaaaggatcatcaaggaccattatcattccttatgaaaaggaagacagcccagaagcttgctattcagaaggctttgtcagatgcattccagaaactgttgattgttgttctagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactag

SEQ ID NO: 173608 - DNA, 501 bp, Homo sapiens
  Payload ID: 14098
  Gene Symbol: RDM1
  Gene Name: RAD52 motif containing 1
  Uniprot ID: Q8NG50
  ENST ID: ENST00000611538
  CDS Start-End: 1-501
atggcggagttggtaccttttgcggttcccatcgagagtgacaaaaccttgctagtgtgggagctgagctccggacccacggccgaggctttgcatcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaaggtcccttgctctccctggaagcagtatggccaagaggaggaagggtatctctcggatttcagcttggaggaggaagagttcaggctgccagaacttgactag

SEQ ID NO: 173609 - DNA, 1032 bp, Homo sapiens
  Payload ID: 14098
  Gene Symbol: RDM1
  Gene Name: RAD52 motif containing 1
  Uniprot ID: Q8NG50
  ENST ID: ENST00000616596
  CDS Start-End: 1-756
atggcggagttggtaccttttgcggttcccatcgagagtgacaaaaccttgctagtgtgggagctgagctccggacccacggccgaggctttgcatcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactagcatttctgaatatcccaaggcgaggtcatgtaacttccttgggaagctctgtcgtgcccctaccccacgccgccccaccactataggctgctggagtcctggaaccacctgggtcggccgcccaaatctttcctggcgaaggggagggaaggggtgttctggtggagtgggaagggaggcttgggtaggattgtgggataagatcgccctggtgacgaggagcggatctcgaacggaacttaataaaggttgcctagataaagatatggtaaataa

SEQ ID NO: 173610 - DNA, 1535 bp, Homo sapiens
  Payload ID: 14098
  Gene Symbol: RDM1
  Gene Name: RAD52 motif containing 1
  Uniprot ID: Q8NG50
  ENST ID: ENST00000619262
  CDS Start-End: 488-1273
tgctggggcgagggttagccgcgcaggtgcggtgaagggaggatggcggagttggtaccttttgcggttcccatcgagagtgacaaaaccttgctagtgtgggagctgagctccggacccacggccgaggctttgcatgtgagccggggccaggatggagggagggatggagaaagctgcccacccgctgactgggagttccggagtcctgcctcagaccctcacctgcctgagcctccgctgaaggactcttaattataaaggggatcccaactgacaactgacgacccccaacagatttttagagtcccggagaggtatctctccaccttcagaacgttttaccttccagtgcttcttaaagtttaggattttaagaggaaaacctgttgattaagtgggaagtgttttgaatcgcatccttcgcgaagagaggtttggggaatatgagggcatgtgcggttttgttttctgggcgtgagatttcatgcatttacttgtcccacccccacagcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaaggaccattatcattccttatgaaaaggaagacagcccagaagcttgctattcagaaggctttgtcagatgcattccagaaactgttgattgttgttctagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactagcatttctgaatatcccaaggcgaggtcatgtaacttccttgggaagctctgtcgtgcccctaccccacgccgccccaccactataggctgctggagtcctggaaccacctgggtcggccgcccaaatctttcctggcgaaggggagggaaggggtgttctggtggagtgggaagggaggcttgggtaggattgtgggataagatcgccctggtgacgaggagcggatctcgaacggaacttaataaaggttgcctagataaa

SEQ ID NO: 173611 - DNA, 432 bp, Homo sapiens
  Payload ID: 14098
  Gene Symbol: RDM1
  Gene Name: RAD52 motif containing 1
  Uniprot ID: Q8NG50
  ENST ID: ENST00000617591
  CDS Start-End: 1-432
atgcatttacttgtcccacccccacagcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaaggtcccttgctctccctggaagcagtatggccaagaggaggaagggtatctctcggatttcagcttggaggaggaagagttcaggctgccagaacttgactag

SEQ ID NO: 173612 - DNA, 542 bp, Homo sapiens
  Payload ID: 14098
  Gene Symbol: RDM1
  Gene Name: RAD52 motif containing 1
  Uniprot ID: Q8NG50
  ENST ID: ENST00000615378
  CDS Start-End: 18-368
tctgggcgtgagatttcatgcatttacttgtcccacccccacagcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaaggaccattatcattccttatgaaaaggaagacagcccagaagcttgctattcagaaggctttgtcagatgcattccagaaactgttgattgttgttctaggtaagactgtcttgatcatccttgaagtacttcagtttcagtaagcaaataaactcattttgaaaagttaattgaataaaaatattgatatctaaa

SEQ ID NO: 173613 - DNA, 1177 bp, Homo sapiens
  Payload ID: 14098
  Gene Symbol: RDM1
  Gene Name: RAD52 motif containing 1
  Uniprot ID: Q8NG50
  ENST ID: ENST00000618461
  CDS Start-End: 47-901
gcaatgctggggcgagggttagccgcgcaggtgcggtgaagggaggatggcggagttggtaccttttgcggttcccatcgagagtgacaaaaccttgctagtgtgggagctgagctccggacccacggccgaggctttgcatcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaaggaccattatcattccttatgaaaaggaagacagcccagaagcttgctattcagaaggctttgtcagatgcattccagaaactgttgattgttgttctagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactagcatttctgaatatcccaaggcgaggtcatgtaacttccttgggaagctctgtcgtgcccctaccccacgccgccccaccactataggctgctggagtcctggaaccacctgggtcggccgcccaaatctttcctggcgaaggggagggaaggggtgttctggtggagtgggaagggaggcttgggtaggattgtgggataagatcgccctggtgacgaggagcggatctcgaacggaacttaataaaggttgcctagataaagatatggtaaataa

SEQ ID NO: 173614 - DNA, 617 bp, Homo sapiens
  Payload ID: 14098
  Gene Symbol: RDM1
  Gene Name: RAD52 motif containing 1
  Uniprot ID: Q8NG50
  ENST ID: ENST00000615024
  CDS Start-End: 1-351
atgcatttacttgtcccacccccacagcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaaggaccattatcattccttatgaaaaggaagacagcccagaagcttgctattcagaaggctttgtcagatgcattccagaaactgttgattgttgttctagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactag

SEQ ID NO: 173615 - DNA, 542 bp, Homo sapiens; identical to SEQ ID NO: 173612
  Payload ID: 14098
  Gene Symbol: RDM1
  Gene Name: RAD52 motif containing 1
  Uniprot ID: Q8NG50
  ENST ID: ENST00000613554
  CDS Start-End: 18-368

SEQ ID NO: 173616 - DNA, 779 bp, Homo sapiens
  Payload ID: 14098
  Gene Symbol: RDM1
  Gene Name: RAD52 motif containing 1
  Uniprot ID: Q8NG50
  ENST ID: ENST00000613308
  CDS Start-End: 14-724
cggtgaagggaggatggcggagttggtaccttttgcggttcccatcgagagtgacaaaaccttgctagtgtgggagctgagctccggacccacggccgaggctttgcatcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaaggaccattatcattccttatgaaaaggaagacagcccagaagcttgctattcagaaggctttgtcagatgcattccagaaactgttgattgttgttctaggtaagactgtcttgatcatccttgaagtacttcagtttcagtaagcaaataaactcattttgaaaagttaattgaataaaaatattgatatctaaagca

SEQ ID NO: 173617 - DNA, 686 bp, Homo sapiens
  Payload ID: 14098
  Gene Symbol: RDM1
  Gene Name: RAD52 motif containing 1
  Uniprot ID: Q8NG50
  ENST ID: ENST00000619193
  CDS Start-End: 1-420
atggcggagttggtaccttttgcggttcccatcgagagtgacaaaaccttgctagtgtgggagctgagctccggacccacggccgaggctttgcatcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaaggaccattatcattccttatgaaaaggaagacagcccagaagcttgctattcagaaggctttgtcagatgcattccagaaactgttgattgttgttctagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactag

SEQ ID NO: 173618 - DNA, 501 bp, Homo sapiens; identical to SEQ ID NO: 173608
  Payload ID: 14098
  Gene Symbol: RDM1
  Gene Name: RAD52 motif containing 1
  Uniprot ID: Q8NG50
  ENST ID: ENST00000612980
  CDS Start-End: 1-501

SEQ ID NO: 173619 - DNA, 1177 bp, Homo sapiens; identical to SEQ ID NO: 173613
  Payload ID: 14098
  Gene Symbol: RDM1
  Gene Name: RAD52 motif containing 1
  Uniprot ID: Q8NG50
  ENST ID: ENST00000620284
  CDS Start-End: 47-901

SEQ ID NO: 173620 - DNA, 1032 bp, Homo sapiens; identical to SEQ ID NO: 173609
  Payload ID: 14098
  Gene Symbol: RDM1
  Gene Name: RAD52 motif containing 1
  Uniprot ID: Q8NG50
  ENST ID: ENST00000616735
  CDS Start-End: 1-756

SEQ ID NO: 173621 - DNA, 1491 bp, Homo sapiens
  Payload ID: 14098
  Gene Symbol: RDM1
  Gene Name: RAD52 motif containing 1
  ENST ID: ENST00000619876
  CDS Start-End: 472-1113
agccgcgcaggtgcggtgaagggaggatggcggagttggtaccttttgcggttcccatcgagagtgacaaaaccttgctagtgtgggagctgagctccggacccacggccgaggctttgcatgtgagccggggccaggatggagggagggatggagaaagctgcccacccgctgactgggagttccggagtcctgcctcagaccctcacctgcctgagcctccgctgaaggactcttaattataaaggggatcccaactgacaactgacgacccccaacagatttttagagtcccggagaggtatctctccaccttcagaacgttttaccttccagtgcttcttaaagtttaggattttaagaggaaaacctgttgattaagtgggaagtgttttgaatcgcatccttcgcgaagagaggtttggggaatatgagggcatgtgcggttttgttttctgggcgtgagatttcatgcatttacttgtcccacccccacagcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaaggaccattatcattccttatgaaaaggaagacagcccagaagcttgctattcagaaggctttgtcagatgcattccagaaactgttgattgttgttctaggtaagactgtcttgatcatccttgaagtacttcagtttcagtaagcaaataaactcattttgaaaagttaattgaataaaaatattgatatctaaagcactctatagtatgctttcatttgctaaattatttcacaccaacaggctcaaatttgttctgtgtgacatttgtgaaaaaaaatgacagcaaatattgtccccagtttacagatgtgaaaagacttgcctcagttcccacagaaaatgtttaagccaggtcttctttaattgcttacctatcatacagaatagtgattataagttttggacgcatggatttgagtcctaactctgtctcttagatttttaatgcaattaggccgggcgcggtggctcacgcctgtaatcccagcactttgggaggccgagatgggcggatcacga

SEQ ID NO: 173622 - DNA, 687 bp, Homo sapiens
  Payload ID: 14098
  Gene Symbol: RDM1
  Gene Name: RAD52 motif containing 1
  Uniprot ID: Q8NG50
  ENST ID: ENST00000619828
  CDS Start-End: 1-687
atgcatttacttgtcccacccccacagcattctctgttcacagcattttctcagtttggccttctgtattcagtccgggtcttcccaaatgctgcagtggcccatcctggtttctatgccgtcattaagttttattctgcaagggctgcccacagagcccaaaaggcatgcgaccggaagcagctttttcagaaatctccagtcaaggttcgtcttggcaccagacataaggcagttcaacatcaagcccttgccctgaacagttccaaatgccaagaactggcgaattactactttggtttcaatgggtgttccaaaaggatcatcaagcttcaggagctttctgaccttgaagaaagggaaaatgaagatagcatggtgccacttccgaagcaaagcctgaagttcttctgtgctttagaagtggtgttgccatcctgtgattgcaggagtcctggcattggcttggtggaggagcctatggataaggtggaggaagaaagtggtaaaatagctgtggagtacagacccagtgaagacatcgtaggtgtcagatgcgaagaagaactacacggtttaattcaagtcccttgctctccctggaagcagtatggccaagaggaggaagggtatctctcggatttcagcttggaggaggaagagttcaggctgccagaacttgactag

SEQ ID NO: 173623 - DNA, 686 bp, Homo sapiens; identical to SEQ ID NO: 173617
  Payload ID: 14098
  Gene Symbol: RDM1
  Gene Name: RAD52 motif containing 1
  Uniprot ID: Q8NG50
  ENST ID: ENST00000632131
  CDS Start-End: 1-420

SEQ ID NO: 173624 - DNA, 617 bp, Homo sapiens; identical to SEQ ID NO: 173614
  Payload ID: 14098
  Gene Symbol: RDM1
  Gene Name: RAD52 motif containing 1
  Uniprot ID: Q8NG50
  ENST ID: ENST00000634177
  CDS Start-End: 1-351

SEQ ID NO: 173625 - DNA, 506 bp, Homo sapiens; identical to SEQ ID NO: 173607
  Payload ID: 14098
  Gene Symbol: RDM1
  Gene Name: RAD52 motif containing 1
  Uniprot ID: Q8NG50
  ENST ID: ENST00000634031
  CDS Start-End: 1-240

SEQ ID NO: 173626 - DNA, 779 bp, Homo sapiens; identical to SEQ ID NO: 173616
  Payload ID: 14098
  Gene Symbol: RDM1
  Gene Name: RAD52 motif containing 1
  Uniprot ID: Q8NG50
  ENST ID: ENST00000632931
  CDS Start-End: 14-724

SEQ ID NO: 173627 - DNA, 518 bp, Homo sapiens; identical to SEQ ID NO: 173606
  Payload ID: 14098
  Gene Symbol: RDM1
  Gene Name: RAD52 motif containing 1
  Uniprot ID: Q8NG50
  ENST ID: ENST00000633612
  CDS Start-End: 1-345

SEQ ID NO: 173628 - DNA, 1491 bp, Homo sapiens; identical to SEQ ID NO: 173621
  Payload ID: 14098
  Gene Symbol: RDM1
  Gene Name: RAD52 motif containing 1
  ENST ID: ENST00000632708
  CDS Start-End: 472-1113

SEQ ID NO: 173629 - DNA, 587 bp, Homo sapiens; identical to SEQ ID NO: 173605
  Payload ID: 14098
  Gene Symbol: RDM1
  Gene Name: RAD52 motif containing 1
  Uniprot ID: Q8NG50
  ENST ID: ENST00000633984
  CDS Start-End: 1-414

SEQ ID NO: 173630 - DNA, 687 bp, Homo sapiens; identical to SEQ ID NO: 173622
  Payload ID: 14098
  Gene Symbol: RDM1
  Gene Name: RAD52 motif containing 1
  Uniprot ID: Q8NG50
  ENST ID: ENST00000633122
  CDS Start-End: 1-687

SEQ ID NO: 173631 - DNA, 432 bp, Homo sapiens; identical to SEQ ID NO: 173611
  Payload ID: 14098
  Gene Symbol: RDM1
  Gene Name: RAD52 motif containing 1
  Uniprot ID: Q8NG50
  ENST ID: ENST00000632922
  CDS Start-End: 1-432

SEQ ID NO: 173632 - DNA, 1535 bp, Homo sapiens; identical to SEQ ID NO: 173610
  Payload ID: 14098
  Gene Symbol: RDM1
  Gene Name: RAD52 motif containing 1
  Uniprot ID: Q8NG50
  ENST ID: ENST00000632857
  CDS Start-End: 488-1273

SEQ ID NO: 173633 - DNA, 3068 bp, Homo sapiens
  Payload ID: 14099
  Gene Symbol: RAD54B
  Gene Name: RAD54 homolog B (S. cerevisiae)
  Uniprot ID: Q9Y620
  ENST ID: ENST00000336148
  CDS Start-End: 126-2858
gattggcttcgccgaggcgggatccttgagcttctccggcggcgaggggatagctggttaccagaaggacttctttgcagggccagtggtttctgtcagattttcgccggtcacgactgctgaatatgagacgatctgcagcaccaagtcagttgcaggggaattccttcaaaaaaccaaaatttatacctccaggaagaagtaatccaggtctgaatgaagagattacaaaactgaatccagatataaaattatttgagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacagttcattcggctcctaaagaagtagcagtgtccaaggaacaagaagagaaatctgatagcctagttaaatatttcagtgttgtttggtgtaagccttcaaagaaaaaacataaaaagtgggaaggtgatgctgttcttattgtaaaaggaaagtcatttatattaaagaatttggaaggcaaagacattggaagaggcattggttataaattcaaagagcttgaaaagattgaagagggccaaacactgatgatttgtggaaaagaaatagaagtcatgggtgtaatctctccagatgacttcagcagtggcaggtgttttcagcttggaggaggaagtactgctatctcgcattcttctcaggttgccaggaaatgtttctctaaccctttcaaaagtgtttgtaaaccaagttcaaaggaaaatagacagaatgatttccaaaattgcaaaccacgccatgacccatatacgccaaattccctcgttatgccacgaccagataagaatcaccagtgggtattcaataagaactgtttccctcttgtggatgtagtgattgatccttaccttgtatatcatcttcgaccacatcagaaagaaggaatcatattcctttatgaatgtgtaatgggaatgagaatgaatggcagatgtggagctattcttgctgatgaaatgggtttagggaagacattgcaatgtatttcgctcatctggaccctgcagtgtcagggaccctatggaggcaagccagtaataaagaagacactaattgtcacacctggaagcttggtgaataattggaagaaagaatttcaaaaatggctaggaagtgaaaggatcaagatatttactgttgatcaggaccacaaagttgaagaattcatcaagtctatattttattctgttcttattatcagttatgaaatgttacttcgttccctggatcaaattaagaatataaaatttgatcttctaatctgtgacgaggggcatcgtttgaagaacagtgccattaagacaactacagccctcattagcctttcttgtgagaaaagaataattctaactggtactccaattcagaatgatctgcaagaattttttgcattaattgattttgtaaatccaggaatattaggctctttgtcatcttataggaaaatatatgaagaacccatcattttatcgagagaaccttctgcttctgaggaagaaaaggagttaggagaaagaagagcagctgaacttacttgcctcactggactctttatccttagaagaacccaagaaattataaataaatatctcccacctaaaatagagaatgttgtcttttgccgaccaggagcactacagattgagctttatcgaaagctgttaaattctcaggttgtcaggttctgccttcaagggttgttggaaaatagtccccatctaatatgtataggagctcttaaaaaactgtgcaatcacccctgccttttgttcaactctataaaggaaaaggaatgtagctcaacttgtgataaaaatgaagaaaagagtctatacaaaggcttgctaagtgtgtttcctgctgactacaaccctctcctgtttactgaaaaggagtcaggaaaactacaggtgttgtccaagctcttagcggttatccacgaacttcgacctactgaaaaggtggtgttggtatccaactatacacaaaccttgaacattttacaagaagtatgtaagcgtcatggatatgcttatacaagacttgatggacaaacaccaatctctcaaaggcagcagattgttgatggctttaacagtcaacactcttctttttttatttttttgttaagttcaaaagctggtggtgtaggacttaacctcattggaggatctcacttaattctctatgacattgattggaatccagccactgacattcaggcaatgtctagagtatggagagatggtcagaaatatcctgtacatatttacagactcctaactacaggtacaatagaagaaaagatctatcaaaggcagatcagtaagcaaggtctttgtggggcagttgtcgacctcaccaagacatctgaacatattcagttttcagtagaagaacttaaaaatttgttcacattacatgaaagttcagattgtgttactcatgatctgcttgactgtgagtgtacaggagaagaagttcatacaggtgattcgttggaaaaattcattgtctctagagattgtcagcttggtccacatcaccagaaatctaactccctgaaacctctttctatgtcccagctgaagcaatggaaacatttttctggagatcatttaaatcttacagatccttttcttgaaagaataacagaaaatgtgtcattcatttttcagaatataaccactcaagctactggcacatagtgaaagattacttctgacattccattgctcttcttttgaaaattagtatggtaattaaatgtactttttgaaaattaatagaattatttaaattacagtatatgttgcaaaatatatcacttttgatacaatagtcaaaattgagtggtttaatgttttgtaaatattaagtgtttaaatgaaaaataaagatgtgcttatatcattgta

SEQ ID NO: 173634 - DNA, 472 bp, Homo sapiens
  Payload ID: 14099
  Gene Symbol: RAD54B
  Gene Name: RAD54 homolog B (S. cerevisiae)
  ENST ID: ENST00000523839
  CDS Start-End: 96-472
tcctccaggcctctgaagaagaaattcagaacaaagaataatagcagttagagttcagtcctgtttcccctaatctgaggtcacgactgctgaatatgagacgatctgcagcaccaagtcagttgcaggggaattccttcaaaaaaccaaaatttatacctccaggaagaagtaatccaggtctgaatgaagagattacaaaactgaatccagatataaaattatttgagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacagttcattcggctcctaaagaagtagcagtgtccaaggaacaagaagagaaatctgatagcctagttaaatattt

SEQ ID NO: 173635 - DNA, 1879 bp, Homo sapiens
  Payload ID: 14099
  Gene Symbol: RAD54B
  Gene Name: RAD54 homolog B (S. cerevisiae)
  Uniprot ID: Q9Y620
  ENST ID: ENST00000297592
  CDS Start-End: 79-432
ggatagctggttaccagaaggacttctttgcagggccagtggtttctgtcagattttcgccggtcacgactgctgaatatgagacgatctgcagcaccaagtcagttgcaggggaattccttcaaaaaaccaaaatttatacctccaggaagaagtaatccaggtctgaatgaagagattacaaaactgaatccagatataaaattatttgagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacagtgcaaacttggatgaggaggcacaggctggtaccagttcactacaggtaatgttggatcaccatcctgttgctattacagtggaggtgaagcaagaagaagacattaaaccacctcctccactggttttaaattctcaacagagtgatactttagagcaaagagaagaacatgaattagtacatgttatggaaagatccttgtcgccttcactttcctctgttgatatgagaatgacatcgtctccatcttctattccaaggagagatgatttttttcggcatgagagtggtgaacactttaggtcactattagggtatgatcctcagatcctgcaaatgttgaaagaggagcatcagataattttagaaaatcaaaaaaattttggattgtatgttcaggagaagagggatggattgaaaagaaggcagcagctagaggaagagctactaagagcaaaaattgaagtggagaagctgaaagcaattcgcttacggcatgatctacctgaatataacagtctctaagtttttttttcaatcttgcaatttgataattttgattttggccaaattactttaatttgggaatatcctgaaacagaatacacgttcttgaaaaatgttgttaatctctattatggaaaaactttttagatataattttctaattattttcttttgagatattaaaatttactggttggttggcatggttatagtttttattgtcttcttttttttttccctaagtttaattgttgaccttacaaaagatattttattctgatcactaagatatacacaaatgcatatacaaacacatattctttcaaagttctgagtcttcaacatttttagttagaactttgaaagctataattagagatttttaagtcagtctaatttaggagctatactaacctaataccaagaagcttgtctgtatgacattggtttttatgcttttatcttttgaaggagtaaatcctaggattttagagatggaagatatttggagaacactttttttccatctctgcagtttaggggtaatgaaacaggtccagggagaactcaatgacttacttagggtaacaaagctatttatggcagagcagagaccagcacttagtttttctttgtgtaatttccatcccgctattcgatagaagtaaatatccactaaaacattctctagatttaaatattagaagcatttctttcattaaaattgcctttaaagattgttaggttgtgaaatcaggataattacatcaattacccccattctctctctatttttgttccagcaaaatagataaggtattccattgaagctattatatattttggctgtgtgatttaaagacatgtcttaattcattttgaatgtcctgttctggaaaaaatttctttcacagtaaaaatcagaatgaacaaaattaaaattttatgtattttataagtattgttattttagtattcatggaaataaa

SEQ ID NO: 173636 - DNA, 599 bp, Homo sapiens
  Payload ID: 14099
  Gene Symbol: RAD54B
  Gene Name: RAD54 homolog B (S. cerevisiae)
  ENST ID: ENST00000518998
  CDS Start-End: 71-229
ggttaccagaaggacttctttgcagggccagtggtttctgtcagattttcgccggtcacgactgctgaatatgagacgatctgcagcaccaagtcagttgcaggggaattccttcaaaaaaccaaaatttatacctccaggaagaagtaatccaggtctgaatgaagagattacaaaactgaatccagatataaaattatttgagttcattcggctcctaaagaagtagcagtgtccaaggaacaagaagagaaatctgatagcctagttaaatatttcagtgttgtttggtgtaagccttcaaagaaaaaacataaaaagtgggaaggtgatgctgttcttattgtaaaaggaaagtcatttatattaaagaatttggaaggcaaagacattggaagaggcattggttataaattcaaagagcttgaaaagattgaagagggccaaacactgatgatttgtggaaaagaaatagaagtcatgggtgtaatctctccagatgacttcagcagtggcaggtgttttcagcttggaggaggaagtactgctatctcgcattcttctcaggttgccaggaaatgtttctctaaccctttcaa

SEQ ID NO: 173637 - DNA, 1699 bp, Homo sapiens
  Payload ID: 14099
  Gene Symbol: RAD54B
  Gene Name: RAD54 homolog B (S. cerevisiae)
  ENST ID: ENST00000463267
  CDS Start-End: 99-464
gagcttctccggcggcgaggggatagctggttaccagaaggacttctttgcagggccagtggtttctgtcagattttcgccggtcacgactgctgaatatgagacgatctgcagcaccaagtcagttgcaggggaattccttcaaaaaaccaaaatttatacctccaggaagaagtaatccaggtctgaatgaagagattacaaaactgaatccagatataaaattatttgagggtgttgcaattaataacacctttctcccgtcacaaaatgatcttagaatatgcagtttaaatctgcctagtgaagaaagtactagagaaatcaataacagagataattgcagtggaaaatattgttttgaagcacctacactggcaacattagatccacctcatacagtgcaaacttggatgaggaggcacaggctggtaccagttcactacagttcattcggctcctaaagaagtagcagtgtccaaggaacaagaagagaaatctgatagcctagttaaatatttcagtgttgtttggtgtaagccttcaaagaaaaaacataaaaagtgggaaggtgatgctgttcttattgtaaaaggaaagtcatttatattaaagaatttggaaggcaaagacattggaagaggcattggttataaattcaaagagcttgaaaagattgaagagggccaaacactgatgatttgtggaaaagaaatagaagtcatgggtgtaatctctccagatgacttcagcagtggcaggtgttttcagcttggaggaggaagtactgctatctcgcattcttctcaggttgccaggaaatgtttctctaaccctttcaaaagtgtttgtaaaccaagttcaaaggaaaatagacagaatgatttccaaaattgcaaaccacgccatgacccatatacgccaaattccctcgttatgccacgaccagataagaatcaccagtgggtattcaataagaactgtttccctcttgtggatgtagtgattgatccttaccttgtatatcatcttcgaccacatcagaaagaaggaatcatattcctttatgaatgtgtaatgggaatgagaatgaatggcagatgtggagctattcttgctgatgaaatgggtttagggaagacattgcaatgtatttcgctcatctggaccctgcagtgtcagggaccctatggaggcaagccagtaataaagaagacactaattgtcacacctggaagcttggtgaataattggaagaaagaatttcaaaaatggctaggaagtgaaaggatcaagatatttactgttgatcagttatgaaatgttacttcgttccctggatcaaattaagaatataaaatttgatcttctaatctgtgacgaggggcatcgtttgaagaacagtgccattaagacaactacagccctcattagcctttcttgtgagaaaagaataattctaactggtactccaattcagaatgatctgcaagaattttttgcattaattgattttgtaaatccaggaatattaggctctttgtcatcttataggaaaatatatgaagaacccatcattttatcgagagaaccttctgcttctgaggaagaaaaggagttaggagaaagaagagcagctgaacttacttgcctcactggactctttatccttagaagaacccaagaaattataaataaa

SEQ ID NO: 173638 - DNA, 3089 bp, Homo sapiens
  Payload ID: 14099
  Gene Symbol: RAD54B
  Gene Name: RAD54 homolog B (S. cerevisiae)
  ENST ID: ENST00000611249
  CDS Start-End: 699-2879
gtttgtgaaaagagctgagcagagctgaaggctgcatggtggtttcagaaactgcctacttaatttgaaaagaacaatggtaggaaaggctagatcttccaattttaccttatccgaaaagcttgatttgctaaagcttgtgaagccatatgtgaaaattctcgaagaacacactaataaacattcagtaatagtagaaaagaatagatgttgggatatcatagcagttaactataatgcaattggagtagaccgccctcctcgaacagcacagggcctacgcaccctttataaaaggctcaaagaatatgccaaacaggagctattgcagcaaaaagagacccaatcagattttaaaagcaatatttctgagccaaccaagaaagttatggagatgattccccagatttccagtttttgcctggtaagagacaggaaccacatacaaagttcattcggctcctaaagaagtagcagtgtccaaggaacaagaagagaaatctgatagcctagttaaatatttcagtgttgtttggtgtaagccttcaaagaaaaaacataaaaagtgggaaggtgatgctgttcttattgtaaaaggaaagtcatttatattaaagaatttggaaggcaaagacattggaagaggcattggttataaattcaaagagcttgaaaagattgaagagggccaaacactgatgatttgtggaaaagaaatagaagtcatgggtgtaatctctccagatgacttcagcagtggcaggtgttttcagcttggaggaggaagtactgctatctcgcattcttctcaggttgccaggaaatgtttctctaaccctttcaaaagtgtttgtaaaccaagttcaaaggaaaatagacagaatgatttccaaaattgcaaaccacgccatgacccatatacgccaaattccctcgttatgccacgaccagataagaatcaccagtgggtattcaataagaactgtttccctcttgtggatgtagtgattgatccttaccttgtatatcatcttcgaccacatcagaaagaaggaatcatattcctttatgaatgtgtaatgggaatgagaatgaatggcagatgtggagctattcttgctgatgaaatgggtttagggaagacattgcaatgtatttcgctcatctggaccctgcagtgtcagggaccctatggaggcaagccagtaataaagaagacactaattgtcacacctggaagcttggtgaataattggaagaaagaatttcaaaaatggctaggaagtgaaaggatcaagatatttactgttgatcaggaccacaaagttgaagaattcatcaagtctatattttattctgttcttattatcagttatgaaatgttacttcgttccctggatcaaattaagaatataaaatttgatcttctaatctgtgacgaggggcatcgtttgaagaacagtgccattaagacaactacagccctcattagcctttcttgtgagaaaagaataattctaactggtactccaattcagaatgatctgcaagaattttttgcattaattgattttgtaaatccaggaatattaggctctttgtcatcttataggaaaatatatgaagaacccatcattttatcgagagaaccttctgcttctgaggaagaaaaggagttaggagaaagaagagcagctgaacttacttgcctcactggactctttatccttagaagaacccaagaaattataaataaatatctcccacctaaaatagagaatgttgtcttttgccgaccaggagcactacagattgagctttatcgaaagctgttaaattctcaggttgtcaggttctgccttcaagggttgttggaaaatagtccccatctaatatgtataggagctcttaaaaaactgtgcaatcacccctgccttttgttcaactctataaaggaaaaggaatgtagctcaacttgtgataaaaatgaagaaaagagtctatacaaaggcttgctaagtgtgtttcctgctgactacaaccctctcctgtttactgaaaaggagtcaggaaaactacaggtgttgtccaagctcttagcggttatccacgaacttcgacctactgaaaaggtggtgttggtatccaactatacacaaaccttgaacattttacaagaagtatgtaagcgtcatggatatgcttatacaagacttgatggacaaacaccaatctctcaaaggcagcagattgttgatggctttaacagtcaacactcttctttttttatttttttgttaagttcaaaagctggtggtgtaggacttaacctcattggaggatctcacttaattctctatgacattgattggaatccagccactgacattcaggcaatgtctagagtatggagagatggtcagaaatatcctgtacatatttacagactcctaactacaggtacaatagaagaaaagatctatcaaaggcagatcagtaagcaaggtctttgtggggcagttgtcgacctcaccaagacatctgaacatattcagttttcagtagaagaacttaaaaatttgttcacattacatgaaagttcagattgtgttactcatgatctgcttgactgtgagtgtacaggagaagaagttcatacaggtgattcgttggaaaaattcattgtctctagagattgtcagcttggtccacatcaccagaaatctaactccctgaaacctctttctatgtcccagctgaagcaatggaaacatttttctggagatcatttaaatcttacagatccttttcttgaaagaataacagaaaatgtgtcattcatttttcagaatataaccactcaagctactggcacatagtgaaagattacttctgacattccattgctcttcttttgaaaattagtatggtaattaaatgtactttttgaaaattaatagaattatttaaattacagtatatgttgcaaaatatatcacttttgatacaatagtcaaaattgagtggtttaatgttttgtaaatattaagtgtttaaatgaaaaataaagatgtgcttatatcattgta

SEQ ID NO: 173639 - DNA, 3108 bp, Homo sapiens
  Payload ID: 14100
  Gene Symbol: RAD54L
  Gene Name: RAD54-like (S. cerevisiae)
  Uniprot ID: Q92698
  ENST ID: ENST00000371975
  CDS Start-End: 675-2918
ggtcttggcgggtcggtgagtcttggcggctgttaacgcgcgctttgggaacaggaaggttgagagagaggtgctggggtctgcgtctatctctgtcgctcttttcagcccctcctggtattcccctcctaacctgggttttttacacgcccgcgtggcttcctgctcgacctccctgagtctgatcctggtttccacctccagccctgggaaatttcctttctccagactcgccctccccacccgggcctcggactttcaccccagcttctctctcctggccagtgattacccacccccaatcccaccccgccccgccgcgcaactacctcctcccttcacccggactgggaccatcatccccactccactccgcccagtctgggactccacctgcctcctccccaatcccacactaatctctgcttggtctcttcctctttggcctaatctctcgtctcggcttattggggacggccactctcacagtttggttccaaacaccagttcctggatggattcccgccatccatgccccctctttaattagccggtcctctcaataatgtagcagccccctctacagattagaccctggtcctacactcttagccgctgcctgcttttgacctttggctcatgggtacttgacgttttaaactcctaggcccaggatgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggt

SEQ ID NO: 173640 - DNA, 2549 bp, Homo sapiens
  Payload ID: 14100
  Gene Symbol: RAD54L
  Gene Name: RAD54-like (S. cerevisiae)
  Uniprot ID: Q92698
  ENST ID: ENST00000442598
  CDS Start-End: 115-2358
gatacgacggcagcgcggcgggaggttcgattgacccggtcttggcgggtcgccgctgcctgcttttgacctttggctcatgggtacttgacgttttaaactcctaggcccaggatgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggtt

SEQ ID NO: 173641 - DNA, 1121 bp, Homo sapiens
  Payload ID: 14100
  Gene Symbol: RAD54L
  Gene Name: RAD54-like (S. cerevisiae)
  ENST ID: ENST00000488942
  CDS Start-End: 1-964
atgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcgtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgccatcaccttcgtcttccaccagcgttctcatgaggagcagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttt

SEQ ID NO: 173642 - DNA, 648 bp, Homo sapiens
  Payload ID: 14100
  Gene Symbol: RAD54L
  Gene Name: RAD54-like (S. cerevisiae)
  ENST ID: ENST00000469835
  CDS Start-End: 41-648
gcgcgctttgggaacaggaaggttgagagagaggcccaggatgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgcca

SEQ ID NO: 173643 - DNA, 767 bp, Homo sapiens
  Payload ID: 14100
  Gene Symbol: RAD54L
  Gene Name: RAD54-like (S. cerevisiae)
  ENST ID: ENST00000472889
  CDS Start-End: 1-767
gtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctgggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatccta

SEQ ID NO: 173644 - DNA, 775 bp, Homo sapiens
  Payload ID: 14100
  Gene Symbol: RAD54L
  Gene Name: RAD54-like (S. cerevisiae)
  ENST ID: ENST00000459678
  CDS Start-End: 1-337
tctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacc

SEQ ID NO: 173645 - DNA, 574 bp, Homo sapiens
  Payload ID: 14100
  Gene Symbol: RAD54L
  Gene Name: RAD54-like (S. cerevisiae)
  ENST ID: ENST00000476687
  CDS Start-End: 1-207
gttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaa

SEQ ID NO: 173646 - DNA, 810 bp, Homo sapiens
  Payload ID: 14100
  Gene Symbol: RAD54L
  Gene Name: RAD54-like (S. cerevisiae)
  ENST ID: ENST00000493985
  CDS Start-End: 585-810
gacggcagcgcggcgggaggttcgattgacccggtcttggcgggtcgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctgg

SEQ ID NO: 173647 - DNA, 627 bp, Homo sapiens
  Payload ID: 14100
  Gene Symbol: RAD54L
  Gene Name: RAD54-like (S. cerevisiae)
  ENST ID: ENST00000493032
  CDS Start-End: 402-627
aggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaagggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctgg

SEQ ID NO: 173648 - DNA, 718 bp, Homo sapiens
  Payload ID: 14100
  Gene Symbol: RAD54L
  Gene Name: RAD54-like (S. cerevisiae)
  ENST ID: ENST00000463715
  CDS Start-End: 629-718
aatgggtgatacgacggcagcgcggcgggaggttcgattgacccggtcttggcgggtcgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaagga

SEQ ID NO: 173649 - DNA, 834 bp, Homo sapiens
  Payload ID: 14100
  Gene Symbol: RAD54L
  Gene Name: RAD54-like (S. cerevisiae)
  ENST ID: ENST00000473251
  CDS Start-End: 1-182
ttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctgggtacggagccctaacaaagatggctgcactctcctgcacagcctgctgctttcttacgtaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaa

SEQ ID NO: 173650 - DNA, 9776 bp, Homo sapiens
  Payload ID: 14101
  Gene Symbol: RAD54L2
  Gene Name: RAD54-like 2 (S. cerevisiae)
  Uniprot ID: Q9Y4B4
  ENST ID: ENST00000409535
  CDS Start-End: 126-4529
tgtatgtaggctgggagtgtctgctgatcacttggagtgctgtcccttggaacaggaggagtaagattgagcacccctgcagtggaccatgagtcggtaatgcccactgaggacctctgggagccatgtcagacgaatctgcctcagggagcgatccagacctggacccggacgtggagctggaggatgcggaagaggaggaggaggaggaggaggtggcagtggaggagtgtgacagggatgatgaagaagacctgctggatgacccatccctggaaggcatgtgtggcactgagcatgcccagttgggagaagatgggcagcagccgccgcggtgcacttcaactacctcatctcagtctgagccttcagagcagcttaggcgccaccaaggcaagaacctagcctccgaggaccccaaaaagaagagagctcagaagccctcccacatgagaagaaacatacgaaagctactccgggaggatcaattggagcctgttaccaaagcagcacagcaagaagagttggaaagaaggaagcgcctggagcagcagaggaaagattatgcagcccctattcctactgttccgctggagttcctccctgaggaaattgctttaagggcaagtgacggtccccaactgcctcctcgggtcttggcccaggaagtcatttgtttggacagtagcagtggcagtgaggatgaaaaaagcagtcgagatgaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaagaaatcatttgccacaggtagaccgaagaaaaccaagaagcgttctcacccagtcatcattgatctagatgaggaagatcggcagcaggagtttcggagagagtttgagaaggctttatgccgccctggccctgatgtagtaatctgtgatgagggacaccgcatcaaaaactgccaggccagcacctcacaggctctgaagaatatccgctctcgccgccgggtggtgctgactgggtaccctctgcaaaacaacctcattgagtactggtgcatggtggactttgtgcgcccagacttccttggcacccggcaggagttcagcaacatgtttgaacgccctatcctgaatgggcaatgtattgacagcacacctcaggacgtccgcctcatgcggtaccggagccatgtcctgcacagtcttctggagggctttgtgcagaggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggccaaggaccttctgactaattaccagactggagtcctagaaaactctcccaagatggtactgcttttccacctgattgaggaaagtgtgaagcttggggacaagatccttgtgtttagccagagtctttccaccttggctctcatcgaggaattccttggaaaacgagaagtaccctgtccacctggtaccgaggggcaaggagcacagaagtgggttcgaaacatcagctacttccggctagatggtagcacccctgcctttgagagggagcggcttattaatcagttcaatgatcccagcaacctcaccacctggctgttccttctctctacaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcagatcgggtggtggatgatctaaatccaatgctgaacttcacacggaaagaggtggaaaacctactgcactttgttgagaaggagccagctccccaagtttccttgaacgtaaaggggatcaaggagtcagtcctgcaactggcctgtctgaagtaccctcacctcatcaccaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccacagatgtacaggcaagaattaatgctggtgagagcatccacatcatccgtgggacaaaagggacgtacatccgtaccagtgatggacggatctttgctgtccgggcaactggcaaaccaaaggttcctgaagatggtcggatggctgcctcaggttcccagggaccttcttgcgagtccacaagcaacggcagacacagtgcctcatcacccaaagcccccgaccctgaggggctggccaggcccgtctctcctgacagcccagagatcatcagtgagcttcagcagtatgcagatgtggctgctgcccgggaatcccgtcagagctccccaagcaccaatgccgccctgcctggccccccggcccaacttatggacagcagtgctgttcccgggacagctctcggaactgagcctcgactagggggtcattgcctcaatagttccctcttggtgactggccagccctgtggtgacaggcacccagtgctggacttaaggggccacaagcgaaagttggccacaccacctgctgcccaggagtcatcccgccggcggtccaggaagggtcatctgccagcccccgtgcagccgtatgaacacgggtatccagtctctggcgggtttgccatgccacccgtctccttaaaccataacctcaccacccccttcacctcccaggctggggagaactccctgtttatgggcagtaccccctcctactaccagctgtccaatttgctggcagatgcccgcctggtgtttccagtgactactgaccctctggtgccagcaggccccgtcagttcctcttccacggctacctcagtcactgccagcaacccctccttcatgctcaacccttctgtgccagggatactacccagctattcactcccattctcacagccactcctgtccgagccgaggatgtttgcgccttttccttcccctgtcttgcccagcaacctttcgcggggcatgtctatctatccaggctacatgtccccacatgcaggctacccagctggtggcctcctacggtcccaggtgcctccatttgactctcatgaggttgccgaggttgggttcagctccaatgatgatgaggataaagacgatgatgtgatagaggtcactgggaaatagctagggagcccctccccacctcacttggggcccccagcaggttgcccaccaagctgaaaggcagtgatttagaccttttgagaataggacacttggcaggagggaaaaggaagaggacaaaggagggtggttggccaaagtggcagagctctgttgctgtttaacaaaagaggcaaaaaaaaaaaaaaaaaaaaaaaagtccaacacagcagcaatagcgggaaatcagggacccaaaacagggatggaggggcagtgcagcctcttttccttcctgccttgcttatgctgtctgcttgcttgctcgcccatctgagtgtagaagcgcacatcccatttctgtctttgggaacattctttcccaagagagctgccttactaggtgacttagcttggcctggggaggggagtgaaggaagggagaatgagtgagagaaggagggtgggtagggggagcagactgtgatcccatgtgaagtggggtctttttagggggtgggaaggaagctgaccaggtatgtgtgtttgtgagtgtgtgtgtgtatgtttattttgtatgtgtatgtatggaacagagcaggggtgaaggtgggaggggagggagggaagaactaagagggaaactgaaaaatgaatttatctttctttaaatggaagtcagtttggtggttcatggcacctagtgtgaacatcagggtgagcccagaagagccatggaaataacaagtttccttcgggatgggtgaagagaaggcccagctaactcaagtccctggtattcagagccacatttgtgtgagaatttggggaaattcatgagagaaaatgggcattaccaatctatgtctcttaaccccggtggctatctctgagcagctctccctttccagcttggaaggttgtctgtgtgcagaggctgggagggagaagcactgcagtacgtgaatgaaaggtcgcagagttgtggctggaaaatacatttttcaccagggtagaactgagcccccagctgcctatcctggtagtcttttctgttcctttccttcccctttagagagctccatgttaatttatttcttatgggcaattatttattacttggacttttcatgtgtcttgtttatttgggggtggggggaggttaggggtaaggagggtaggtgatagaaagggaagttttaagatatcccagaccctatagccactggtgaaaaacaatcctggatggatggtaaattgaccaggggaagagttaggtttgaccaaggtttggattaaacaactatatttttgagagatggcttttcaggaagatcagggaatcctgagactggatagttagtggagggtgggactcattccacagaaatcgaaagttgtgatcatggagtttgcaattgggaagtaagagaccccagatttggagctgtgtcctcctgggatgatgttagatgttggctctctatgctgaatagtgaagctgtggataggcggttgctgggttgagggactgttgatttcatgttcgaaaatatcttcaggtggtccatgtaggcctggtgtctgctgcctccatctttgaaggaacatggaggagccctttctctgtaggagccctaagtctgggttttatcttaaaagaacacaccagtcattctgggtctccccttattgccattgccaggggagggtcgtctagtccttaagcataaacactggctgtcttcctactggtgtccccgccccctctgtatcccccaccccaacactttgccagacagttctttatgatgaacaaactttggctttagagctttaccacttacccatggctccctccttactgggcaggtggtgtacctgcctcttcccagcccagaaggcagcttagtcaggtcatcccagtagtagctcctacagctcttctgaccagcccatttccatctttggagggccttagcagactctggggtattgtcctcagagaagagacaaggagatgatggatggggtgcatgtgtatatgtgtgtttgtctgctgtccaataacaccaaaagtggaacttaagaagctttgtgttttcataagcaccctgccagacacttaactcttctactcatggaagccttagatctacaatttagctatgcaaattattttaataatttaaaaatagcagttccaaccagtgctttctctttcagatgcatcccaagaatggatggtgaagggactcagttggagtgagctctcaggttgaggctggtgcagtaggagtgagctagactgaatctccaatttatgggacacactcagaacctgggttacactgatgcctctcaggccctggagcactgggatcccagagatgcatgtgtgcatgtgtatgtctgtgtgtgtgtgttgtcgggagaagggggtagtatttctgtgttcacttctaggaaatcactgtactagcctccaagaatccggaaaccttcccagccgggaactgaaaccattccctggagggatgggcttggcttttgaagttgacagaaagtaaatgggtattctgagaggcagcacatgcctactgtctatccagtgttccagggactgggtcttgcttctactcagcagaggccatcattctgggaggctgacctgactagagaaggctttcttttatatgtgcagtttctattgtgtagaggggttgggggtgggatcatgggaaattggagtgctaccaggtccatggtttttgctttttttttttttttttttttttttttttttttttaaagaaaataacctgaaaacacttctgacttttccactgtctctttatatgtgctgataggcaaatgtgcatgcacaccaaacataagcatgtttgtgagggaagcaggaagtatctcagagcctaagaaccatgttttatagtttctttgatcataaacacttggtggtgtcttccacccattatccaggcctgaggggggcagggtggctggtgataagagggagggcagaaaatcaggcctaggcgttttcccttaccattgtcttccatggaatgttttcaagggcctctcaagccccattcatctggtttagccaagttctcagcctggggaacacagtactacttaatgattgaggtttaccatttatagtgatgcttgatttccttttcttaatatatttgtagataaaaattgaacagggacaaagtagctatttaagaaaggaagtgaaccatgttgggtcatatcattttctttagattggatatctatgaagtccacacccctttgagttatgctttttaggcatctatctcatcatctcctgatttaaggataattctgtctggtccttggagctctcttccctaggaattagtgtgtggagtctctatatgcttgtgatccttggagctctcttccctaggaattagtgtgtggagtctctatatgcttgtgattcacaactaaatatgaaatttctcaattcaggagcaggaagcaaagtgctggggtacagttttgcagattggttgaaacacttagccaaacttaagtggcctgggtaggaccatcactcccaaagttgtcagcagagaagggccctctgtgtgagtctattcaaacctggcattgctctgaaattgagtcctcatcccatggggaaggtcttctgggggctttacattccttgttactagtgttctggatattaccttctgcttcccacttccttttttttttttttgagacagagtcttgctctgtcacccaggcttgagtgcaatggtgtgatcttggctccgtgcaacctccactcccggtttcaagcgatcctcctgcctcagcctcccaagtagctgggattacaggtgcacaccaccatgcccagctaatttgtatattttttagtagagacggggtttcaccacgttggccaggctggccttgaactcctgacctcaagtgatccaccctcctcggcctcccagtgatgggattacaggcgtgagccactgctcctggcccccacttccttttgatttctcagatcagtctttcccttctgagccatggccttctgtgcacccagctcagtggctcttcacccctaaaactaagtgaagtcatccttccccaaaaggacccctgggagatgttctggccctctgctgactactcccaggaatcagcacctcaaggactatttgagaatgttgtgctctctattggtcaccttgagactccgttcccctgctgccaactcttctcttctgccctgtgtattctgctgtgatccccttaacggcttttctgtgctactagcttagccctaggccttttatgaatacctgagtcttataacaatgaacttcttgagcaggcagtgtccaacttctttgctcttcagggacctgagtgtgcacctttcccttttgcaggtctatttgacatagtaatctagtgtgttggggaggggtagccaagcaggctgcagtgtctgcaatgcagagggcttggggaggtttgggtactctctgctgccactactgggatgatattcagaagagagaggacctcatactgtgactggacccaggaccctccctggaagagagctcagcccagctgtgtgtgtgtgtgtgtgtgagtgtgtgtgtgtgtgtttgtgtgctgtgctcatgtgcacctgggtgtaaaatgactgttatctggttgtgttactcagggtgggctggggactcaccagaagaatcccccccagcctgcccaagacaggtttttcccttgtaccatcttcagagaggtcaggggaagagggtccaggtgggttaaggggggtcgctatggataaccactaagaccagactgctgccaggaggagtgggggataatgaggtggccccagggtcctggcacctggctttggttttccgtcttctttcctcaggacgcccctgaggcctgggacctgtgcctggcttcgaggagcatctgtggctgggtgatccagctgctggtgtgatcatgggcttccctcctctcagcagggcaggcgctcctgccccagagactgggcaactggctgtttctatgacgtatttatttttacttgtgtttcatgtcacttttttaaaaaaaagcaaacagaacaattgtaagtcagtataactgcctatcagttttctttatttctctttttgtaaaataaaatttaaactcaagaaggca

SEQ ID NO: 173651 - DNA, 3926 bp, Homo sapiens
  Payload ID: 14101
  Gene Symbol: RAD54L2
  Gene Name: RAD54-like 2 (S. cerevisiae)
  ENST ID: ENST00000432863
  CDS Start-End: 1-3889
gttggaaagaaggaagcgcctggagcagcagaggaaagattatgcagcccctattcctactgttccgctggagttcctccctgaggtgattgaactgagctctggagaggaggacactctgcacattgtggacagcagtgaatctgtcagtgaagatgatgaggaagaagagaagggtggcacccatgtcaatgatgtcttaaaccagcgtgacgcccttgggcgggtccttgtcaacctaaaccaccctccagaggaggaaaatgtcttccttgccccacagttggcacgggctgtgaaacctcatcagattggcgggatccggttcctttacgataacctagtggagtctctggagaggtttaagaccagcagtggctttggctgtattctggcccacagcatgggtctggggaaaactttgcaagtgatctctttcatcgacgtcctcttccgccacacgccagccaaaacagtccttgccattgtgccggttaatactcttcagaattggctggcagagttcaacatgtggcttccacctcctgaagccctcccggctgacaacaagcctgaagaagtccagcctcggttctttaaagttcacatcttgaatgatgagcacaagacgatggcatctcgtgctaaagtgatggctgattgggtgtcagagggtggcgtgctgctgatggggtacgagatgtacagactcctcactctgaagaaatcatttgccacaggtagaccgaagaaaaccaagaagcgttctcacccagtcatcattgatctagatgaggaagatcggcagcaggagtttcggagagagtttgagaaggctttatgccgccctggccctgatgtagtaatctgtgatgagggacaccgcatcaaaaactgccaggccagcacctcacaggctctgaagaatatccgctctcgccgccgggtggtgctgactgggtaccctctgcaaaacaacctcattgagtactggtgcatggtggactttgtgcgcccagacttccttggcacccggcaggagttcagcaacatgtttgaacgccctatcctgaatgggcaatgtattgacagcacacctcaggacgtccgcctcatgcggtaccggagccatgtcctgcacagtcttctggagggctttgtgcagaggagaggccacactgtgctgaagattcatctccctgccaaggaagaaaatgtgatccttgtgcggctctccaagatccagcgagatttgtatacacagttcatggatcgcttccgggactgtggtagcagcggttggctggggctgaacccccttaaggcattctgtgtgtgttgcaagatctggaatcaccctgatgtgctgtatgaagcccttcagaaggagagcttggccaatgagcaggacctagacgtggaagaacttggctctgcagggaccagtgcccgctgtccaccacagggaacaaaaggcaagggagaggatagcaccttggcttcctcgatgggagaggcaaccaatagcaagttcctacagggcgttggcttcaaccctttccaggagcgaggcaacaacattgtcacatatgaatgggccaaggaccttctgactaattaccagactggagtcctagaaaactctcccaagatggtactgcttttccacctgattgaggaaagtgtgaagcttggggacaagatccttgtgtttagccagagtctttccaccttggctctcatcgaggaattccttggaaaacgagaagtaccctgtccacctggtaccgaggggcaaggagcacagaagtgggttcgaaacatcagctacttccggctagatggtagcacccctgcctttgagagggagcggcttattaatcagttcaatgatcccagcaacctcaccacctggctgttccttctctctacaagggccggatgcttgggtgtgaatctgattggtgccaaccgagtggtggtgtttgatgcttcctggaacccttgccatgatgcccaggcagtatgtcgggtataccgttatggccagaaaaagccctgttacatctatcgccttgtggctgattacactctagaaaagaagatctatgaccgtcagatttccaagcagggcatgtcagatcgggtggtggatgatctaaatccaatgctgaacttcacacggaaagaggtggaaaacctactgcactttgttgagaaggagccagctccccaagtttccttgaacgtaaaggggatcaaggagtcagtcctgcaactggcctgtctgaagtaccctcacctcatcaccaaggagcctttcgagcatgagtcattgctcttgaaccgaaaggatcacaagctaaccaaggctgagaaaaaagcagcaaagaaaagctatgaggaagacaaacgcacatcagtcccctatacccgcccatcgtatgcgcagtattaccctgccagcgatcagagcctgaccagcatccccgccttcagccagagaaactggcagccaactttgaagggtgatgaaaagcctgtggccagtgttcgtcctgtgcagtccacccccatccccatgatgccccggcatgtcccattgggaggaagtgtaagctctgcctccagcacaaatccatccatgaactttcccatcaactacttgcagcgtgcaggagtccttgtgcagaaggtggtcaccacgacagatattgttattcctggactcaacagctccacagatgtacaggcaagaattaatgctggtgagagcatccacatcatccgtgggacaaaagggacgtacatccgtaccagtgatggacggatctttgctgtccgggcaactggcaaaccaaaggttcctgaagatggtcggatggctgcctcaggttcccagggaccttcttgcgagtccacaagcaacggcagacacagtgcctcatcacccaaagcccccgaccctgaggggctggccaggcccgtctctcctgacagcccagagatcatcagtgagcttcagcagtatgcagatgtggctgctgcccgggaatcccgtcagagctccccaagcaccaatgccgccctgcctggccccccggcccaacttatggacagcagtgctgttcccgggacagctctcggaactgagcctcgactagggggtcattgcctcaatagttccctcttggtgactggccagccctgtggtgacaggcacccagtgctggacttaaggggccacaagcgaaagttggccacaccacctgctgcccaggagtcatcccgccggcggtccaggaagggtcatctgccagcccccgtgcagccgtatgaacacgggtatccagtctctggcgggtttgccatgccacccgtctccttaaaccataacctcaccacccccttcacctcccaggctggggagaactccctgtttatgggcagtaccccctcctactaccagctgtccaatttgctggcagatgcccgcctggtgtttccagtgactactgaccctctggtgccagcaggccccgtcagttcctcttccacggctacctcagtcactgccagcaacccctccttcatgctcaacccttctgtgccagggatactacccagctattcactcccattctcacagccactcctgtccgagccgaggatgtttgcgccttttccttcccctgtcttgcccagcaacctttcgcggggcatgtctatctatccaggctacatgtccccacatgcaggctacccagctggtggcctcctacggtcccaggtgcctccatttgactctcatgaggttgccgaggttgggttcagctccaatgatgatgaggataaagacgatgatgtgatagaggtcactgggaaatagctagggagcccctccccacctcacttggggcccccag

SEQ ID NO: 173652 - DNA, 2119 bp, Homo sapiens
  Payload ID: 14102
  Gene Symbol: RAD9A
  Gene Name: RAD9 checkpoint clamp component A
  Uniprot ID: Q99638
  ENST ID: ENST00000307980
  CDS Start-End: 94-1269
gggccggcaggggcggtgcgcgggaagggaccccggacccggaggtcgcggagagctgggcagtgttggccgctggcggagcgctggggcagcatgaagtgcctggtcacgggcggcaacgtgaaggtgctcggcaaggccgtccactccctgtcccgcatcggggacgagctctacctggaacccttggaggacgggctctccctccggacggtgaactcctcccgctctgcctatgcctgctttctctttgccccgctcttcttccagcaataccaggcagccacccctggtcaggacctgctgcgctgtaagatcctgatgaagtctttcctgtctgtcttccgctcactggcgatgctggagaagacggtggaaaaatgctgcatctccctgaatggccggagcagccgcctggtggtccagctgcattgcaagttcggggtgcggaagactcacaacctgtccttccaggactgtgagtccctgcaggccgtcttcgacccagcctcgtgcccccacatgctccgcgccccagcacgggttctgggggaggctgttctgcccttctctcctgcactggctgaagtgacgctgggcattggccgtggccgcagggtcatcctgcgcagctaccacgaggaggaggcagacagcactgccaaagccatggtgactgagatgtgccttggagaggaggatttccagcagctgcaggcccaggaaggggtggccatcactttctgcctcaaggaattccgggggctcctgagctttgcagagtcagcaaacttgaatcttagcattcattttgatgctccaggcaggcccgccatcttcaccatcaaggactctttgctggacggccactttgtcttggccacactctcagacaccgactcgcactcccaggacctgggctccccagagcgtcaccagccagtgcctcagctccaggctcacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaagttccgctcactgttcttcggctccatcctggcccctgtacgctccccccagggccccagccctgtgctggcggaagacagtgagggtgaaggctgaaccaagaacctgaagcctgtacccagaggccttggactagacgaagccccagccagtggcagaactgggtctctcagccctggggatcagaaaggtgggcttgctggagctgagctgtttcactgcctctcgcaggccccagctggctgtcactgtaaagctgtcccacagcggtcgggcctgggccgttatctccccacaacccccagccaatcaggactttccagacttggccctgaactactgacgttcctacctcttatttctcattgagcctcaggctatactccagctggccaaggctggaaacctgtctccctcaggctcaccttcctaaggaaaatgtcatagtaggtgctgctggcccctggtgatccagcttctctgccaatcatgacctgttccttcctgaagtcctgggcatgcatctgggacccccgtggagctgacaagttttccttgctttcctgatactctttggcgctgacttggaattctaagagccttggacccgagtgtgtggctagggttgccctggctggggcccggtgccgagactcccaagcggctctgtgcagaagagctgccaggcagtgtcttagatgtgagacggaggccatggcgagaatccagctttgacctttattcaagagaccagatgggttgccccaggatccggctgccagccctgaggccaagcacggctggagacccacgacctggcctgccgttgccctgagctgcagcctcggccccaggatcctgctcacagtcaccgcaggtgcaggcaggaagcagccctgggggactggacgctgctattgattcattaaaaaaagaaaagaaaaat

SEQ ID NO: 173653 - DNA, 924 bp, Homo sapiens
  Payload ID: 14102
  Gene Symbol: RAD9A
  Gene Name: RAD9 checkpoint clamp component A
  ENST ID: ENST00000538013
  CDS Start-End: 88-237
gcaggggcggtgcgcgggaagggaccccggacccggaggtcgcggagagctgggcagtgttggccgctggcggagcgctggggcagcatgaagtgcctggtcacgggcggcaacgtgaaggctctccctccggacggtgaactcctcccgctctgcctatgcctgctttctctttgccccgctcttcttccagcaataccaggcagccacccctggtcaggacctgctgcgctgtaagatcctgatgaagtctttcctgtctgtcttccgctcactggcgatgctggagaagacggtggaaaaatgctgcatctccctgaatggccggagcagccgcctggtggtccagctgcattgcaagttcgacagcactgccaaagccatggtgactgagatgtgccttggagaggaggatttccagcagctgcaggcccaggaaggggtggccatcactttctgcctcaaggaattccgggggctcctgagctttgcagagtcagcaaacttgaatcttagcattcattttgatgctccaggcaggcccgccatcttcaccatcaaggactctttgctggacggccactttgtcttggccacactctcagacaccgactcgcactcccaggacctgggctccccagagcgtcaccagccagtgcctcagctccaggctcacagcacaccccacccggacgactttgccaatgacgacattgactcttacatgatcgccatggaaaccactataggcaatgagggctcgcgggtgctgccctccatttccctttcacctggcccccagccccccaagagccccggtccccactccgaggaggaagatgaggctgagcccagtacagtgcctgggactcccccacccaagaaggtagggactggaggtggaggcaggggtgggaggtaggg

SEQ ID NO: 173654 - DNA, 829 bp, Homo sapiens
  Payload ID: 14102
  Gene Symbol: RAD9A
  Gene Name: RAD9 checkpoint clamp component A
  ENST ID: ENST00000544620
  CDS Start-End: 88-829
gcaggggcggtgcgcgggaagggaccccggacccggaggtcgcggagagctgggcagtgttggccgctggcggagcgctggggcagcatgaagtgcctggtcacgggcggcaacgtgaaggtgctcggcaaggccgtccactccctgtcccgcatcggggacgagctctacctggaacccttggaggacgggctctccctccggacggtgaactcctcccgctctgcctatgcctgctttctctttgccccgctcttcttccagcaataccaggcagccacccctggtcaggacctgctgcgctgtaagatcctgatgaagacggtggaaaaatgctgcatctccctgaatggccggagcagccgcctggtggtccagctgcattgcaagttcggggtgcggaagactcacaacctgtccttccaggactgtgagtccctgcaggccgtcttcgacccagcctcgtgcccccacatgctccgcgccccagcacgggttctgggggaggctgttctgcccttctctcctgcactggctgaagtgacgctgggcattggccgtggccgcagggtcatcctgcgcagctaccacgaggaggaggcagacagcactgccaaagccatggtgactgagatgtgccttggagaggaggatttccagcagctgcaggcccaggaaggggtggccatcactttctgcctcaaggaattccgggggctcctgagctttgcagagtcagcaaacttgaatcttagcattcattttgatgctccaggcaggcccgccatcttcaccatcaaggactctttgctggacggccactttgtct

SEQ ID NO: 173655 - DNA, 578 bp, Homo sapiens
  Payload ID: 14102
  Gene Symbol: RAD9A
  Gene Name: RAD9 checkpoint clamp component A
  ENST ID: ENST00000542139
  CDS Start-End: 70-426
aagggaccccggacccggaggtcgcggagagctgggcagtgttggccgctggcggagcgctggggcagcatgaagtgcctggtcacgggcggcaacgtgaaggtgctcggcaaggccgtccactccctgtcccgcatcggggacgagctctacctggaacccttggaggacgggctctccctccggacggtgaactcctcccgctctgcctatgcctgctttctctttgccccgctcttcttccagcaataccaggcagccacccctggtcaggacctgctgcgctgtaagatcctgatgaagtctttcctgtctgtcttccgctcactggcgatgctggagaagacggtggaaaaatgctgcatctccctgaatggccggagcagccgcctggtggtccagctgcattgcaagttcggactgtgagtccctgcaggccgtcttcgacccagcctcgtgcccccacatgctccgcgccccagcacgggttctgggggaggctgttctgcccttctctcctgcactggctgaagtgacgctgggcattggccgtggccgcagggtcatcctgcgcagct

SEQ ID NO: 173656 - DNA, 912 bp, Homo sapiens
  Payload ID: 14102
  Gene Symbol: RAD9A
  Gene Name: RAD9 checkpoint clamp component A
  ENST ID: ENST00000621995
  CDS Start-End: 883-912
gacaacgccatccccagcacacatccacctggggcagccagaaagcactggtttgcaggaactgagggctgcagctctgaaacagggacccaggccagggtcctcaaggtcatagaaccccataaccccattaggtgtcaggggcagaaacaggactgtgtgaagattcacagcctccacctcccttgccttcacggagcttcggcatctacccttattccaggcggctgctcaggggcaccgttctacccctttctgcctggagaaactgccgtttttccttaaaggatcctcgaagccggaaggagcagccacctcccactcccggctgctgcaagcaagctgctttgacttctttctagagttggggattgctgctggagtccgagtctcaggcccagagtgggtgcgatggtcttgcttgcaccctgtatcccccggcagacgcccgggaactctactaagtgggtgaccccagagagctcgcccccacactccgactccgagtccagcactcggtccactgcacagggacctcgcgccccacagctgcgtcctctctgaccttcgcaatccggtgcgcggcccgcggaacgccccgatctccaggggcacggaaggccgaggcgtgccgggggagccaggagcagctggctggcgggcgccgcgggcctccccggtcacgtgacaccccggacaacgtgcgccgtcacgtgacggcagagcctgtgagcgtttttctcacgtgacggaggcgcctgcacgtggaccaatggggaggcgggggcggggccggcaggggcggtgcgcgggaagggaccccggacccggaggtcgcggagagctgggcagtgttggccgctggcggagcgctggggcagcatgaagtgcctggtcacgggcggcaacgtg

SEQ ID NO: 173657 - DNA, 2843 bp, Homo sapiens
  Payload ID: 14103
  Gene Symbol: RAD9B
  Gene Name: RAD9 checkpoint clamp component B
  ENST ID: ENST00000358071
  CDS Start-End: 217-480
agggcggatggcagccatgctgaagtgcgtgatgagcggcagtcagtatttgggaaagcagttcaagctctatcacgaattagtgacgagttctggctagacccatctaaaaaaggtcttgctctaagatgtgtgaattcttctcggtcagcatatggatgtgtcctgttctctcctgtgttttttcagcattatcaatggtcagctttagtgaaaatgagtgaaaatgaacttgacacaacactgcatttaaaatgcaaattgggaatgaagtcaattttgcccatctttagatgtctgaattcccttgaaagaaatatagagaagtgcagaatattcaccagatctgataaatgcaaagtagttattcaattcttctacagacatgcaacgtggatggaactagaggtcactatgttaagtgaaataagccaggcatggaaagtcaagtattgcatgttctcacaatgtggacgctaaaaagttgatctcatggaggtagagagtagaatggtagataccagaggctggtaatggtgtgtgggtattaaaagaactcataatatatgttttcaagaaagtcagcctttgcaagttatttttgacaagaatgtttgtactaatacgctaatgattcaaccaagattgcttgctgatgccattgttctttttacatcaagtcaagaggaagttactcttgctgttactccactgaatttttgcctcaagagttctaatgaggaatcaatggatttgagcaatgctgtacacagtgagatgtttgttggctcagatgagtttgacttctttcaaattggaatggacactgagataacattttgtttcaaagaattgaagggaatactgacattttcagaagctacacatgctcctatatccatttattttgatttccctgggaaacctctggctttgagtattgatgatatgttagtggaagctaactttattttggccacattagctgatgaacaaagtagagcatcttcaccacagtcactgtgtctttcacagaaacgaaaaaggtcagatctgattgaaaaaaaggctggcaaaaatgtaactggccaggccctggaatgtatttcaaaaaaagcagcaccaagaaggctttatcctaaggagactctcacaaacatatctgcattggaaaactgtggcagccctgcaatgaaaagagtggatggagatgtcagtgaagtatcagaaagcagtgtcagcaacacagaggaagtgccagggtctctgtgtctcagaaagttttcttgcatgttctttggagcagtttcttctgaccagcaagaacacttcaaccaccctttcgacagtctggcaagagcaagtgacagtgaagaggacatgaataatggcagtttctctatattctaatgcttaatgatggctgagctgggccccagcccagtgactggctcatttgcccctcaagcacgagtttgcatgtttagtgtctaaaagaggttgtccaggacttccttttaatggaggatgggcttttaaaccacatcatcttgtacaacaaccatatctagaaatagctgtttgtcaagtgtatgtaacttgctttaaatccattatgctacttgtgaggcagaagagttttctgtgaaggaaaaaagcccattagagttcttcaattcaatgcacgttcaccctagagcttttaacatctttgctagttttataaaggtatttaaactttattcaacagccatttagagtgccatcaagatggcttgaaatggaattttgtgatttgtagtcaggtatcttttgtatttgattgcaaacatttggattttagttttctcatgtaataccatggccttttttgtgcattgttttttatattttaagactttaagtagaataaaccctggaaaaaagatcaagagtaaaaatatatagtcactttcacttggcttttttagacggagtctcactttgtcactcaggctcaagtgcagtggtgcaatctctgctcactgcaacatctgcctcccaggtccaagcgattctcctgcctcagcctcccgtgcagctgggattgcaggtgcgtgccaccatgcctggctaatttctggtattttgtagagacagggtttcgccatgttggccagggtggtcttgaactcctggcctcaagtgatctgcccacctcggcctcccaaagtgctgggattacagacttgagccactgcgcccaacctggagtgtttttacatattgtaaaattttatttcctaacctcaaattgttctgattttcagatgtgattttttattttgcagtgtgctgcaggaaagaatttaatggaagtgatgccaaatatttctgtattatctgacatagaacagtatcctccactgccaagacagcctgagtttggagtggaataaggtggaagacaaatgtctctgttctttggccctttaagagttagctttttacctgcacaaatggactaaaaaatctggcacaaaacattgttatgtaatgtcttatgatgtgtgcctctccctcccccaaacctgtttacagtcaattataacctgacaaacgagacttttgtaacatattattgttacatctttctgaaaccttcaaaccgtaaggaagtgttaactggcaagcagttgtactttagactttgtgagaaattcataaaggtggctgagtggatttgcatgctttagaactgtgaatagagttctaactgaaaccagaattaatttggctcttgtagcttagtaatgagtcatagctacccacaataacctaataaaaactcaagttcatcccaa

SEQ ID NO: 173658 - DNA, 1846 bp, Homo sapiens
  Payload ID: 14103
  Gene Symbol: RAD9B
  Gene Name: RAD9 checkpoint clamp component B
  ENST ID: ENST00000392672
  CDS Start-End: 100-1389
gcagagacgagatcgcgaagctttgaaaagcgcgggcaacatccgggcacctgggccgtcgagctgaggcgcgccttccgagcctgctttttagggcggatggcagccatgctgaagtgcgtgatgagcggcagtcaggtgaaagtatttgggaaagcagttcaagctctatcacgaattagtgacgagttctggctagacccatctaaaaaaggtcttgctctaagatgtgtgaattcttctcggtcagcatatggatgtgtcctgttctctcctgtgttttttcagcattatcaatggtcagctttagtgaaaatgagtgaaaatgaacttgacacaacactgcatttaaaatgcaaattgggaatgaagtcaattttgcccatctttagatgtctgaattcccttgaaagaaatatagagaagtgcagaatattcaccagatctgataaatgcaaagtagttattcaattcttctacagacatggtattaaaagaactcataatatatgttttcaagaaagtcagcctttgcaagttatttttgacaagaatgtttgtactaatacgctaatgattcaaccaagattgcttgctgatgccattgttctttttacatcaagtcaagaggaagttactcttgctgttactccactgaatttttgcctcaagagttctaatgaggaatcaatggatttgagcaatgctgtacacagtgagatgtttgttggctcagatgagtttgacttctttcaaattggaatggacactgagataacattttgtttcaaagaattgaagggaatactgacattttcagaagctacacatgctcctatatccatttattttgatttccctgggaaacctctggctttgagtattgatgatatgttagtggaagctaactttattttggccacattagctgatgaacaaagtagagcatcttcaccacagtcactgtgtctttcacagaaacgaaaaaggtcagatctgattgaaaaaaaggctggcaaaaatgtaactggccaggccctggaatgtatttcaaaaaaagcagcaccaagaaggctttatcctaaggagactctcacaaacatatctgcattggaaaactgtggcagccctgcaatgaaaagagtggatggagatgtcagtgaagtatcagaaagcagtgtcagcaacacagaggaagtgccagggtctctgtgtctcagaaagttttcttgcatgttctttggagcagtttcttctgaccagcaagaacacttcaaccaccctttcgacagtctggcaagagcaagtgacagtgaagaggacatgaataatgtgtgctgcaggaaagaatttaatggaagtgatgccaaatatttctgtattatctgacatagaacagtatcctccactgccaagacagcctgagtttggagtggaataaggtggaagacaaatgtctctgttctttggccctttaagagttagctttttacctgcacaaatggactaaaaaatctggcacaaaacattgttatgtaatgtcttatgatgtgtgcctctccctcccccaaacctgtttacagtcaattataacctgacaaacgagacttttgtaacatattattgttacatctttctgaaaccttcaaaccgtaaggaagtgttaactggcaagcagttgtactttagactttgtgagaaattcataaaggtggctgagtggatttgcatgctttagaactgtgaatagagttctaactgaaaccagaattaatttggctcttgtagcttagtaatgagtcatagctacccacaataacctaataaaaactcaagttcatcccaa

SEQ ID NO: 173659 - DNA, 2732 bp, Homo sapiens
  Payload ID: 14103
  Gene Symbol: RAD9B
  Gene Name: RAD9 checkpoint clamp component B
  ENST ID: ENST00000409300
  CDS Start-End: 48-1301
gggccgtcgagctgaggcgcgccttccgagcctgctttttagggcggatggcagccatgctgaagtgcgtgatgagcggcagtcaggtgaaagtatttgggaaagcagttcaagctctatcacgaattagtgacgagttctggctagacccatctaaaaaaggtcttgctctaagatgtgtgaattcttctcggtcagcatatggatgtgtcctgttctctcctgtgttttttcagcattatcaatggtcagctttagtgaaaatgagtgaaaatgaacttgacacaacactgcatttaaaatgcaaattgggaatgaagtcaattttgcccatctttagatgtctgaattcccttgaaagaaatatagagaagtgcagaatattcaccagatctgataaatgcaaagtagttattcaattcttctacagacatggtattaaaagaactcataatatatgttttcaagaaagtcagcctttgcaagttatttttgacaagaatgtttgtactaatacgctaatgattcaaccaagattgcttgctgatgccattgttctttttacatcaagtcaagaggaagttactcttgctgttactccactgaatttttgcctcaagagttctaatgaggaatcaatggatttgagcaatgctgtacacagtgagatgtttgttggctcagatgagtttgacttctttcaaattggaatggacactgagataacattttgtttcaaagaattgaagggaatactgacattttcagaagctacacatgctcctatatccatttattttgatttccctgggaaacctctggctttgagtattgatgatatgttagtggaagctaactttattttggccacattagctgatgaacaaagtagagcatcttcaccacagtcactgtgtctttcacagaaacgaaaaaggtcagatctgattgaaaaaaaggctggcaaaaatgtaactggccaggccctggaatgtatttcaaaaaaagcagcaccaagaaggctttatcctaaggagactctcacaaacatatctgcattggaaaactgtggcagccctgcaatgaaaagagtggatggagatgtcagtgaagtatcagaaagcagtgtcagcaacacagaggaagtgccagggtctctgtgtctcagaaagttttcttgcatgttctttggagcagtttcttctgaccagcaagaacacttcaaccaccctttcgacagtctggcaagagcaagtgacagtgaagaggacatgaataatggcagtttctctatattctaatgcttaatgatggctgagctgggccccagcccagtgactggctcatttgcccctcaagcacgagtttgcatgtttagtgtctaaaagaggttgtccaggacttccttttaatggaggatgggcttttaaaccacatcatcttgtacaacaaccatatctagaaatagctgtttgtcaagtgtatgtaacttgctttaaatccattatgctacttgtgaggcagaagagttttctgtgaaggaaaaaagcccattagagttcttcaattcaatgcacgttcaccctagagcttttaacatctttgctagttttataaaggtatttaaactttattcaacagccatttagagtgccatcaagatggcttgaaatggaattttgtgatttgtagtcaggtatcttttgtatttgattgcaaacatttggattttagttttctcatgtaataccatggccttttttgtgcattgttttttatattttaagactttaagtagaataaaccctggaaaaaagatcaagagtaaaaatatatagtcactttcacttggcttttttagacggagtctcactttgtcactcaggctcaagtgcagtggtgcaatctctgctcactgcaacatctgcctcccaggtccaagcgattctcctgcctcagcctcccgtgcagctgggattgcaggtgcgtgccaccatgcctggctaatttctggtattttgtagagacagggtttcgccatgttggccagggtggtcttgaactcctggcctcaagtgatctgcccacctcggcctcccaaagtgctgggattacagacttgagccactgcgcccaacctggagtgtttttacatattgtaaaattttatttcctaacctcaaattgttctgattttcagatgtgattttttattttgcagtgtgctgcaggaaagaatttaatggaagtgatgccaaatatttctgtattatctgacatagaacagtatcctccactgccaagacagcctgagtttggagtggaataaggtggaagacaaatgtctctgttctttggccctttaagagttagctttttacctgcacaaatggactaaaaaatctggcacaaaacattgttatgtaatgtcttatgatgtgtgcctctccctcccccaaacctgtttacagtcaattataacctgacaaacgagacttttgtaacatattattgttacatctttctgaaaccttcaaaccgtaaggaagtgttaactggcaagcagttgtactttagactttgtgagaaattcataaaggtggctgagtggatttgcatgctttagaactgtgaatagagttctaactgaaaccagaattaatttggctcttgtagcttagtaatgagtcatagctacccacaataacctaataaaaactcaagttcatccc

SEQ ID NO: 173660 - DNA, 2727 bp, Homo sapiens
  Payload ID: 14103
  Gene Symbol: RAD9B
  Gene Name: RAD9 checkpoint clamp component B
  Uniprot ID: Q6WBX8
  ENST ID: ENST00000409425
  CDS Start-End: 257-1294
gggccgtcgagctgaggcgcgccttccgagcctgctttttagggcggatggcagccatgctgaagtgcgtgatgagcggcagtcagtatttgggaaagcagttcaagctctatcacgaattagtgacgagttctggctagacccatctaaaaaaggtcttgctctaagatgtgtgaattcttctcggtcagcatatggatgtgtcctgttctctcctgtgttttttcagcattatcaatggtcagctttagtgaaaatgagtgaaaatgaacttgacacaacactgcatttaaaatgcaaattgggaatgaagtcaattttgcccatctttagatgtctgaattcccttgaaagaaatatagagaagtgcagaatattcaccagatctgataaatgcaaagtagttattcaattcttctacagacatggtattaaaagaactcataatatatgttttcaagaaagtcagcctttgcaagttatttttgacaagaatgtttgtactaatacgctaatgattcaaccaagattgcttgctgatgccattgttctttttacatcaagtcaagaggaagttactcttgctgttactccactgaatttttgcctcaagagttctaatgaggaatcaatggatttgagcaatgctgtacacagtgagatgtttgttggctcagatgagtttgacttctttcaaattggaatggacactgagataacattttgtttcaaagaattgaagggaatactgacattttcagaagctacacatgctcctatatccatttattttgatttccctgggaaacctctggctttgagtattgatgatatgttagtggaagctaactttattttggccacattagctgatgaacaaagtagagcatcttcaccacagtcactgtgtctttcacagaaacgaaaaaggtcagatctgattgaaaaaaaggctggcaaaaatgtaactggccaggccctggaatgtatttcaaaaaaagcagcaccaagaaggctttatcctaaggagactctcacaaacatatctgcattggaaaactgtggcagccctgcaatgaaaagagtggatggagatgtcagtgaagtatcagaaagcagtgtcagcaacacagaggaagtgccagggtctctgtgtctcagaaagttttcttgcatgttctttggagcagtttcttctgaccagcaagaacacttcaaccaccctttcgacagtctggcaagagcaagtgacagtgaagaggacatgaataatggcagtttctctatattctaatgcttaatgatggctgagctgggccccagcccagtgactggctcatttgcccctcaagcacgagtttgcatgtttagtgtctaaaagaggttgtccaggacttccttttaatggaggatgggcttttaaaccacatcatcttgtacaacaaccatatctagaaatagctgtttgtcaagtgtatgtaacttgctttaaatccattatgctacttgtgaggcagaagagttttctgtgaaggaaaaaagcccattagagttcttcaattcaatgcacgttcaccctagagcttttaacatctttgctagttttataaaggtatttaaactttattcaacagccatttagagtgccatcaagatggcttgaaatggaattttgtgatttgtagtcaggtatcttttgtatttgattgcaaacatttggattttagttttctcatgtaataccatggccttttttgtgcattgttttttatattttaagactttaagtagaataaaccctggaaaaaagatcaagagtaaaaatatatagtcactttcacttggcttttttagacggagtctcactttgtcactcaggctcaagtgcagtggtgcaatctctgctcactgcaacatctgcctcccaggtccaagcgattctcctgcctcagcctcccgtgcagctgggattgcaggtgcgtgccaccatgcctggctaatttctggtattttgtagagacagggtttcgccatgttggccagggtggtcttgaactcctggcctcaagtgatctgcccacctcggcctcccaaagtgctgggattacagacttgagccactgcgcccaacctggagtgtttttacatattgtaaaattttatttcctaacctcaaattgttctgattttcagatgtgattttttattttgcagtgtgctgcaggaaagaatttaatggaagtgatgccaaatatttctgtattatctgacatagaacagtatcctccactgccaagacagcctgagtttggagtggaataaggtggaagacaaatgtctctgttctttggccctttaagagttagctttttacctgcacaaatggactaaaaaatctggcacaaaacattgttatgtaatgtcttatgatgtgtgcctctccctcccccaaacctgtttacagtcaattataacctgacaaacgagacttttgtaacatattattgttacatctttctgaaaccttcaaaccgtaaggaagtgttaactggcaagcagttgtactttagactttgtgagaaattcataaaggtggctgagtggatttgcatgctttagaactgtgaatagagttctaactgaaaccagaattaatttggctcttgtagcttagtaatgagtcatagctacccacaataacctaataaaaactcaagttcatcccaa

SEQ ID NO: 173661 - DNA, 1373 bp, Homo sapiens
  Payload ID: 14103
  Gene Symbol: RAD9B
  Gene Name: RAD9 checkpoint clamp component B
  ENST ID: ENST00000409778
  CDS Start-End: 25-1050
ttccgagcctgctttttagggcggatggcagccatgctgaagtgcgtgatgagcggcagtcaggtgaaagtatttgggaaagcagttcaagctctatcacgaattagtgacgagttctggctagacccatctaaaaaaggtcttgctctaagatgtgtgaattcttctcggtcagcatatggatgtgtcctgttctctcctgtgttttttcagcattatcaatggtcagctttagtgaaaatgagtgaaaatgaacttgacacaacactgcatttaaaatgcaaattgggaatgaagtcaattttgcccatctttagatgtctgaattcccttgaaagaaatatagagaagtgcagaatattcaccagatctgataaatgcaaagtagttattcaattcttctacagacatgatttgagcaatgctgtacacagtgagatgtttgttggctcagatgagtttgacttctttcaaattggaatggacactgagataacattttgtttcaaagaattgaagggaatactgacattttcagaagctacacatgctcctatatccatttattttgatttccctgggaaacctctggctttgagtattgatgatatgttagtggaagctaactttattttggccacattagctgatgaacaaagtagagcatcttcaccacagtcactgtgtctttcacagaaacgaaaaaggtcagatctgattgaaaaaaaggctggcaaaaatgtaactggccaggccctggaatgtatttcaaaaaaagcagcaccaagaaggctttatcctaaggagactctcacaaacatatctgcattggaaaactgtggcagccctgcaatgaaaagagtggatggagatgtcagtgaagtatcagaaagcagtgtcagcaacacagaggaagtgccagggtctctgtgtctcagaaagtgtgctgcaggaaagaatttaatggaagtgatgccaaatatttctgtattatctgacatagaacagtatcctccactgccaagacagcctgagtttggagtggaataaggtggaagacaaatgtctctgttctttggccctttaagagttagctttttacctgcacaaatggactaaaaaatctggcacaaaacattgttatgtaatgtcttatgatgtgtgcctctccctcccccaaacctgtttacagtcaattataacctgacaaacgagacttttgtaacatattattgttacatctttctgaaaccttcaaaccgtaaggaagtgttaactggcaagcagttgtactttagactttgtgagaaattcataaaggtggctgagtggatttgcatgctttagaactgtgaatagagttctaactgaaa

SEQ ID NO: 173662 - DNA, 2794 bp, Homo sapiens
  Payload ID: 14103
  Gene Symbol: RAD9B
  Gene Name: RAD9 checkpoint clamp component B
  Uniprot ID: Q6WBX8
  ENST ID: ENST00000409246
  CDS Start-End: 326-1363
aaagccgtttgggaacttgtggaggcggggtggtagagtgcagagacgagatcgcgaagctttgaaaagcgcgggcaacatccgggcacctgggccgtcgagctgaggcgcgccttccgagcctgctttttagggcggatggcagccatgctgaatatttgggaaagcagttcaagctctatcacgaattagtgacgagttctggctagacccatctaaaaaaggtcttgctctaagatgtgtgaattcttctcggtcagcatatggatgtgtcctgttctctcctgtgttttttcagcattatcaatggtcagctttagtgaaaatgagtgaaaatgaacttgacacaacactgcatttaaaatgcaaattgggaatgaagtcaattttgcccatctttagatgtctgaattcccttgaaagaaatatagagaagtgcagaatattcaccagatctgataaatgcaaagtagttattcaattcttctacagacatggtattaaaagaactcataatatatgttttcaagaaagtcagcctttgcaagttatttttgacaagaatgtttgtactaatacgctaatgattcaaccaagattgcttgctgatgccattgttctttttacatcaagtcaagaggaagttactcttgctgttactccactgaatttttgcctcaagagttctaatgaggaatcaatggatttgagcaatgctgtacacagtgagatgtttgttggctcagatgagtttgacttctttcaaattggaatggacactgagataacattttgtttcaaagaattgaagggaatactgacattttcagaagctacacatgctcctatatccatttattttgatttccctgggaaacctctggctttgagtattgatgatatgttagtggaagctaactttattttggccacattagctgatgaacaaagtagagcatcttcaccacagtcactgtgtctttcacagaaacgaaaaaggtcagatctgattgaaaaaaaggctggcaaaaatgtaactggccaggccctggaatgtatttcaaaaaaagcagcaccaagaaggctttatcctaaggagactctcacaaacatatctgcattggaaaactgtggcagccctgcaatgaaaagagtggatggagatgtcagtgaagtatcagaaagcagtgtcagcaacacagaggaagtgccagggtctctgtgtctcagaaagttttcttgcatgttctttggagcagtttcttctgaccagcaagaacacttcaaccaccctttcgacagtctggcaagagcaagtgacagtgaagaggacatgaataatggcagtttctctatattctaatgcttaatgatggctgagctgggccccagcccagtgactggctcatttgcccctcaagcacgagtttgcatgtttagtgtctaaaagaggttgtccaggacttccttttaatggaggatgggcttttaaaccacatcatcttgtacaacaaccatatctagaaatagctgtttgtcaagtgtatgtaacttgctttaaatccattatgctacttgtgaggcagaagagttttctgtgaaggaaaaaagcccattagagttcttcaattcaatgcacgttcaccctagagcttttaacatctttgctagttttataaaggtatttaaactttattcaacagccatttagagtgccatcaagatggcttgaaatggaattttgtgatttgtagtcaggtatcttttgtatttgattgcaaacatttggattttagttttctcatgtaataccatggccttttttgtgcattgttttttatattttaagactttaagtagaataaaccctggaaaaaagatcaagagtaaaaatatatagtcactttcacttggcttttttagacggagtctcactttgtcactcaggctcaagtgcagtggtgcaatctctgctcactgcaacatctgcctcccaggtccaagcgattctcctgcctcagcctcccgtgcagctgggattgcaggtgcgtgccaccatgcctggctaatttctggtattttgtagagacagggtttcgccatgttggccagggtggtcttgaactcctggcctcaagtgatctgcccacctcggcctcccaaagtgctgggattacagacttgagccactgcgcccaacctggagtgtttttacatattgtaaaattttatttcctaacctcaaattgttctgattttcagatgtgattttttattttgcagtgtgctgcaggaaagaatttaatggaagtgatgccaaatatttctgtattatctgacatagaacagtatcctccactgccaagacagcctgagtttggagtggaataaggtggaagacaaatgtctctgttctttggccctttaagagttagctttttacctgcacaaatggactaaaaaatctggcacaaaacattgttatgtaatgtcttatgatgtgtgcctctccctcccccaaacctgtttacagtcaattataacctgacaaacgagacttttgtaacatattattgttacatctttctgaaaccttcaaaccgtaaggaagtgttaactggcaagcagttgtactttagactttgtgagaaattcataaaggtggctgagtggatttgcatgctttagaactgtgaatagagttctaactgaaaccagaattaatttggctcttgtagcttagtaatgagtcatagctacccacaataacctaataaaaactcaagttcatccc

SEQ ID NO: 173663 - DNA, 1870 bp, Homo sapiens
  Payload ID: 14104
  Gene Symbol: RHNO1
  Gene Name: RAD9-HUS1-RAD1 interacting nuclear orphan 1
  Uniprot ID: Q9BSD3
  ENST ID: ENST00000489288
  CDS Start-End: 153-869
gtctcggcattccgggctcgaaggctgtgcggtctgccaggagctgcggccccgtccggcccgggctggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggtgcccagcaagcccattgaccacagcaccatcacttcctgggtatcacctgattttgatacagcagcaggaagcttgttcccagcctaccagaaacaccaaaaccgggcgagacactcaagtcgaaaacctaccacctccaagtttccacatctaacttttgagagtccgcaatcttccagttcagagacattggggatccccttaatccgagagtgccccagtgaatcagaaaaggatgtttccagaagacccttagttccagtgctcagtccccaaagctgtgggaacatgtcagtgcaggcacttcagagcttaccttatgtgttcattccacctgatatccagaccccagagtcatcgtctgtgaaggaagaactcattccccaagatcagaaggaaaacagccttctaagctgcactcttcacactggcactcctaatagcccagagcctggacctgttctggttaaagacacccccgaggacaagtatggaataaaggtcacatggaggagacgacagcacctgcttgcttacctcagggagagagggaagctgagcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagtagagatgtggtttctccatgttggccaggctggtctcaaaatcctgacctcaagtcatctgctggccttgacctcacaaagtgctggcccagccgagatttgttttctaagatactttgtgtcatgaacagttcagtttagtgtcatgaactattcacttcatatttttcttgtattaactgtttaaatttttaaaatatcttgtagtaactctttaaaatgtatgtaagtaaatggctgcagaaagtttttttagagaatcctgcttccatcagtaatacagcaatattaccccatccactaatggtctttgtttccttaaccactactcattaatccttaatcacctcattcaaactaattcattctgcatttttgagtaccaactcttgtcaggctcagtggcagcttctacgacctgatggatggaaaaaaatcaaactctgtgactctatggttgactgccacctctgcaaccttgactcatctgctgaaaaggcaagaagaagaaagggcagcaagccctgttttagggactacataagatgaggggagataagggggacatagatgagttctttaggattgcgtgtgttttgagtttttgtttctaactgaagaaatctgtcaatattaaatagggtgggaaaatggtttcttagaataactgttcaactgtgtgtaaataaggaaagttttcaatgagtattacttattgtaattaatgcagaaggacttccccagtcaa

SEQ ID NO: 173664 - DNA, 1655 bp, Homo sapiens
  Payload ID: 14104
  Gene Symbol: RHNO1
  Gene Name: RAD9-HUS1-RAD1 interacting nuclear orphan 1
  Uniprot ID: Q9BSD3
  ENST ID: ENST00000461997
  CDS Start-End: 169-843
aatcggcgccggccttgtctcggcattccgggctcgaaggctgtgcggtctgccaggagctgcggccccgtccggcccgggctggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggtatcacctgattttgatacagcagcaggaagcttgttcccagcctaccagaaacaccaaaaccgggcgagacactcaagtcgaaaacctaccacctccaagtttccacatctaacttttgagagtccgcaatcttccagttcagagacattggggatccccttaatccgagagtgccccagtgaatcagaaaaggatgtttccagaagacccttagttccagtgctcagtccccaaagctgtgggaacatgtcagtgcaggcacttcagagcttaccttatgtgttcattccacctgatatccagaccccagagtcatcgtctgtgaaggaagaactcattccccaagatcagaaggaaaacagccttctaagctgcactcttcacactggcactcctaatagcccagagcctggacctgttctggttaaagacacccccgaggacaagtatggaataaaggtcacatggaggagacgacagcacctgcttgcttacctcagggagagagggaagctgagcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagtagagatgtggtttctccatgttggccaggctggtctcaaaatcctgacctcaagtcatctgctggccttgacctcacaaagtgctggcccagccgagatttgttttctaagatactttgtgtcatgaacagttcagtttagtgtcatgaactattcacttcatatttttcttgtattaactgtttaaatttttaaaatatcttgtagtaactctttaaaatgtatgtaagtaaatggctgcagaaagtttttttagagaatcctgcttccatcagtaatacagcaatattaccccatccactaatggtctttgtttccttaaccactactcattaatccttaatcacctcattcaaactaattcattctgcatttttgagtaccaactcttgtcaggctcagtggcagcttctacgacctgatggatggaaaaaaatcaaactctgtgactctatggttgactgccacctctgcaaccttgactcatctgctgaaaaggcaagaagaagaaagggcagcaagccctgttttagggactacataagatgaggggagataa

SEQ ID NO: 173665 - DNA, 583 bp, Homo sapiens
  Payload ID: 14104
  Gene Symbol: RHNO1
  Gene Name: RAD9-HUS1-RAD1 interacting nuclear orphan 1
  ENST ID: ENST00000538636
  CDS Start-End: 189-583
aatcggcgccggccttgtctcggcattccgggctcgaaggctgtgcggtctgccaggagctgcggccccgtccggcccgggctgcttttgtttcttctctacaggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggtgcccagcaagcccattgaccacagcaccatcacttcctgggtatcacctgattttgatacagcagcaggaagcttgttcccagcctaccagaaacaccaaaaccgggcgagacactcaagtcgaaaacctaccacctccaagtttccacatctaacttttgagagtccgcaatcttccagttcagagacattggggatccccttaatccgagagtgccccagtgaatcagaaaaggatgtttccagaagacccttagttccagtgct

SEQ ID NO: 173666 - DNA, 543 bp, Homo sapiens
  Payload ID: 14104
  Gene Symbol: RHNO1
  Gene Name: RAD9-HUS1-RAD1 interacting nuclear orphan 1
  ENST ID: ENST00000535978
  CDS Start-End: 145-324
attccgggctcgaaggctgtgcggtctgccaggagctgcggccccgtccggcccgggctggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggtgcccagcaagcccattgaccacagcaccatcacttcctgggcattctgctaggtgctgggaatcaagaacaagaccactggtccctaccctcatgaagtttaaagataaataagttatatctagaccaggtgttgtggcttacgcctgtaatcccagcactttgggaggctgaggtatcacctgattttgatacagcagcaggaagcttgttcccagcctaccagaaacaccaaaaccgggcgagacactcaagtcgaaaacctaccacct

SEQ ID NO: 173667 - DNA, 517 bp, Homo sapiens
  Payload ID: 14104
  Gene Symbol: RHNO1
  Gene Name: RAD9-HUS1-RAD1 interacting nuclear orphan 1
  ENST ID: ENST00000366285
  CDS Start-End: 326-517
attccgggctcgaaggctgtgcggtctgccaggagctgcggccccgtccggcccgggctgcactttaggaggccgaggcgggtggatcacttgaggtcacgagttcgagaccagcctggcaacatagcgaaaccgcttctctactaaaaattagccgggcgtggtggtgcgtgcctgtagtcccagctactctggaggctgaggtggaaggatcacctgaggccgagaggtggaggctatggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggtgcccagcaagcccattgaccacagcaccatcacttcctgggtatcacctgattttgatacagca

SEQ ID NO: 173668 - DNA, 580 bp, Homo sapiens
  Payload ID: 14104
  Gene Symbol: RHNO1
  Gene Name: RAD9-HUS1-RAD1 interacting nuclear orphan 1
  ENST ID: ENST00000538700
  CDS Start-End: 266-580
attccgggctcgaaggctgtgcggtctgccaggagctgcggccccgtccggcccgggctggtataggaggctgtgctccccaaagccttgaagtttatggtagaattggctggcagaggatcaggaagaactggggaatcatctgaattatttgctcccagcttttgtttcttctctacaggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggtgcccagcaagcccattgaccacagcaccatcacttcctgggtatcacctgattttgatacagcagcaggaagcttgttcccagcctaccagaaacaccaaaaccgggcgagacactcaagtcgaaaacctaccacctccaagtttccacatctaacttttgagagtccgcaatcttccagttcagag

SEQ ID NO: 173669 - DNA, 2070 bp, Homo sapiens
  Payload ID: 14104
  Gene Symbol: RHNO1
  Gene Name: RAD9-HUS1-RAD1 interacting nuclear orphan 1
  Uniprot ID: Q9BSD3
  ENST ID: ENST00000618250
  CDS Start-End: 290-1006
aatcggcgccggccttgtctcggcattccgggctcgaaggctgtgcggtctgccaggagctgcggccccgtccggcccgggctggtataggaggctgtgctccccaaagccttgaagtttatggtagaattggctggcagaggatcaggaagaactggggaatcatctgaattatttgctcccagcttttgtttcttctctacaggcatgggttggaattggagcctatcccccaacccgaaggctaacagcatcatgtggttactaactgttcctcattcaccggttgatgcctcccagaaaaaaacgccgccagccttcccagaaagccccgctgctgttccaccaacaaccactggagggccccaaacacagctgtgcatctacacagcttcccatcactcacactcgacaggtgcccagcaagcccattgaccacagcaccatcacttcctgggtatcacctgattttgatacagcagcaggaagcttgttcccagcctaccagaaacaccaaaaccgggcgagacactcaagtcgaaaacctaccacctccaagtttccacatctaacttttgagagtccgcaatcttccagttcagagacattggggatccccttaatccgagagtgccccagtgaatcagaaaaggatgtttccagaagacccttagttccagtgctcagtccccaaagctgtgggaacatgtcagtgcaggcacttcagagcttaccttatgtgttcattccacctgatatccagaccccagagtcatcgtctgtgaaggaagaactcattccccaagatcagaaggaaaacagccttctaagctgcactcttcacactggcactcctaatagcccagagcctggacctgttctggttaaagacacccccgaggacaagtatggaataaaggtcacatggaggagacgacagcacctgcttgcttacctcagggagagagggaagctgagcagaagccaattccttgtgaaaagctgactgccatcagtaatctcaatagaaaagagatatgttttctggagtcataaaggaattcaattcctagggtttttgtttttgtttttgagatgtaatattgctctgttgcccaggctggagtgcagtggtatgatctcaccttactgcaaccaccacttcctgggttcaagcgattctcctgcctcagcctccccagtagctgggattacaggcaccagccaccatgcctggctaatttttttgtatttttagtagagatgtggtttctccatgttggccaggctggtctcaaaatcctgacctcaagtcatctgctggccttgacctcacaaagtgctggcccagccgagatttgttttctaagatactttgtgtcatgaacagttcagtttagtgtcatgaactattcacttcatatttttcttgtattaactgtttaaatttttaaaatatcttgtagtaactctttaaaatgtatgtaagtaaatggctgcagaaagtttttttagagaatcctgcttccatcagtaatacagcaatattaccccatccactaatggtctttgtttccttaaccactactcattaatccttaatcacctcattcaaactaattcattctgcatttttgagtaccaactcttgtcaggctcagtggcagcttctacgacctgatggatggaaaaaaatcaaactctgtgactctatggttgactgccacctctgcaaccttgactcatctgctgaaaaggcaagaagaagaaagggcagcaagccctgttttagggactacataagatgaggggagataagggggacatagatgagttctttaggattgcgtgtgttttgagtttttgtttctaactgaagaaatctgtcaatattaaatagggtgggaaaatggtttcttagaataactgttcaactgtgtgtaaataaggaaagttttcaatgagtattacttattgtaattaatgcagaaggacttccccagtcaaccgaatgtctcggccttttactcagacaagtagcatctcattaaacccattcatttagcattc

SEQ ID NO: 173670 - DNA, 2175 bp, Homo sapiens
  Payload ID: 14105
  Gene Symbol: RSPH3
  Gene Name: radial spoke 3 homolog (Chlamydomonas)
  Uniprot ID: Q86UC2
  ENST ID: ENST00000252655
  CDS Start-End: 191-1873
ggctgccaggggcgtgttatcgcgggggcagcctgggagcgctgctgcgccgcggcaggagaaacagccgaggacaccctggaagagcaggagcacgtgggcctgcgagaatggcgccaacaccagccctgcaaagccacattccaaagccgggccaaggacagccaccgttgccccgcaggcctcaaggatgacggtcaagccagccaaggccgcctccctagccaggaacctcgcaaagcgcaggcgcacctacctgggtggcgcggctgggcggagtcaagagccggaagtcccttgtgccgcagtccttcccgggaaacctggggaccggaactgcccggagttcccgcccccagacagaaccctgggttgctgggcaaccgatgcggcccccgcagctggtctctgtggtgctgggagcgagcccagtatagctcccacctcctgcgctggtaacctcccgtcccgcccgcctcccttgttgtcgcctctcctcgcgtcgcggaatccttgcccttggcactacttacatctctccgggtcccacaacaccttagcgcccacctgcttcaaagccaagctccaccgaaagcgaggcagtcagcccccggacatggcctcagcgctgactgatcgcacctctcgggccccgagcacctacacctacaccagccggccccgagcactgccctgccagcgcagccgttaccgggacagcctgacgcagccagatgaagaacctatgcattatggaaacataatgtatgacagaagggtaattcgaggtaacacttatgcactccagacagggccactgctcggacggcctgattctctagagctccagagacaacgggaggctaggaagagggctcttgccagaaaacaagcccaagagcagctcagaccacaaacacctgaacctgtggaaggcagaaagcatgtcgatgtgcaaacagaattataccttgaagaaattgctgatcgcataatagaagttgatatggaatgccaaacagatgcatttttggacagaccaccaacaccactctttattcctgccaaaactggcaaagatgtggccacccaaatactagaaggagagctctttgactttgatcttgaagttaaaccagtgttagaagttttggtggggaagacaattgagcagtctcttctggaagtaatggaagaagaagagctggctaacctgcgggccagtcagcgtgagtatgaagaactacggaatagtgaacgtgctgaagttcaacgacttgaagagcaagagaggcgacaccgagaagaaaaagaacggcgtaagaaacagcagtgggaaataatgcacaagcacaacgagacatcacaaaaaatcgccgcccgagcatttgcacagcgttacctggctgaccttctcccgtctgtttttggcagcctcagggatagtggctacttttatgatcccattgaaagagatattgagataggatttcttccatggctaatgaatgaagttgaaaaaaccatggaatatagcatggtgggaagaacagtgcttgacatgttgatccgtgaggtggttgaaaagaggctgtgtatgtatgagcatggggaagacacacatcagtctccagaacccgaggatgagcctggtggtcctggagcaatgacagagtcactggaggcctctgaattcctggagcagagcatgtcacagacacgggagctgcttttagatggaggctacctacaaagaacaacatatgacagaaggtcatcccaggaaaggaagtttatggaagagagagaactcttagggcaagatgaagaaacagcaatgaggaagtccttaggggaggaagaattgtcataggagggaagcttcaaagtcatgaaaccaatcaacagccaagtcagcaagcaatcaggtaatgatgtgcgagtcccctcaggttatagaaattatgttgtatttagtcagtatgtctttttgtgtaatggactgggccaatcaaatgtgataaaattaatttgagaatgaaacttaaattgaattcatttatttaatagaatattcaaaggctatattgtaattctaatgagaattatatttaattactagctttctattaccattatatgtaaccagcaaatatatttttccttagcccttct

SEQ ID NO: 173671 - DNA, 6561 bp, Homo sapiens
  Payload ID: 14105
  Gene Symbol: RSPH3
  Gene Name: radial spoke 3 homolog (Chlamydomonas)
  ENST ID: ENST00000367069
  CDS Start-End: 638-1894
acgtaacagagctgggagcctggctgccaggggcgtgttatcgcgggggcagcctgggagcgctgctgcgccgcggcaggagaaacagccgaggacaccctggaagagcaggagcacgtgggcctgcgagaatggcgccaacaccagccctgcaaagccacattccaaagccgggccaaggacagccaccgttgccccgcaggcctcaaggatgacggtcaagccagccaaggccgcctccctagccaggaacctcgcaaagcgcaggcgcacctacctgggtggcgcggctgggcggagtcaagagccggaagtcccttgtgccgcagtccttcccgggaaacctggggaccggaactgcccggagttcccgcccccagacagaaccctgggttgctgggcaaccgatgcggcccccgcagctggtctctgtggtgctgggagcgagcccagtatagctcccacctcctgcgctggtaacctcccgtcccgcccgcctcccttgttgtcgcctctcctcgcgtcgcggaatccttgcccttggcactacttacatctctccgggtcccacaacaccttagcgcccacctgcttcaaagccaagctccaccgaaagcgaggcagtcagcccccggacatggcctcagcgctgactgatcgcacctctcgggccccgagcacctacacctacaccagccggccccgagcactgccctgccagcgcagccgttaccgggacagcctgacgcagccagatgaagaacctatgcattatggaaacataatgtatgacagaagggtaattcgaggtaacacttatgcactccagacagggccactgctcggacggcctgattctctagagctccagagacaacgggaggctaggaagagggctcttgccagaaaacaagcccaagagcagctcagaccacaaacacctgaacctgtggaaggcagaaagcatgtcgatgtgcaaacagaattataccttgaagaaattgctgatcgcataatagaagttgatatggaatgccaaacagatgcatttttggacagaccaccaacaccactctttattcctgccaaaactggcaaagatgtggccacccaaatactagaaggagagctctttgactttgatcttgaagttaaaccagtgttagaagttttggtggggaagacaattgagcagtctcttctggaagtaatggaagaagaagagctggctaacctgcgggccagtcagcgtgagtatgaagaactacggaatagtgaacgtgctgaagttcaacgacttgaagagcaagagaggcgacaccgagaagaaaaagaacggcgtaagaaacagcagtgggaaataatgcacaagcacaacgagacatcacaaaaaatcgccgcccgagcatttgcacagcgttacctggctgaccttctcccgtctgtttttggcagcctcagggatagtggctacttttatgatcccattgaaagagatattgagataggatttcttccatggctaatgaatgaagttgaaaaaaccatggaatatagcatggtgggaagaacagtgcttgacatgttgatccgtgaggtggttgaaaagaggctgtgtatgtatgagcatggggaagacacacatcagtctccagaacccgaggatgagcctggtggtcctggagcaatgacagagtcactggaggcctctgaattcctggagcagagcatgtcacagacacgggagctgcttttagatggaggctacctacaaagaacaacatatgacagaaggtcatcccaggaaaggaagtttatggaagagagagaactcttagggcaagatgaagaaacagcaatgaggaagtccttaggggaggaagaattgtcataggagggaagcttcaaagtcatgaaaccaatcaacagccaagtcagcaagcaatcaggtaatgatgtgcgagtcccctcaggttatagaaattatgttgtatttagtcagtatgtctttttgtgtaatggactgggccaatcaaatgtgataaaattaatttgagaatgaaacttaaattgaattcatttatttaatagaatattcaaaggctatattgtaattctaatgagaattatatttaattactagctttctattaccattatatgtaaccagcaaatatatttttccttagcccttctaattttgcgggttagttttttttagtaagtatgatatttaatgttcaatatcagtgctgtcagccatatagcttttcttctctataggaaaactatttcacctactgtaagagtgaatgcctagccaggcgtggtggctcacacctgtaatcccagcactttgggaggctgaggctggcagatcccctgaggtcgggagtttgagaccagccagaccaacaaggagaaaccccatctctgctaaaaatacaaaattagccaggcatggtggcgcatgcctgtaatcctagctacttgggaggctgaggcaggagaatcacttgaacctggggcggaggttgcggtgagccaagtttgcaccattgcactccagcctgggcaacaagagcaaaactccgtctcaaaaaaaaaagaaaaaaaagagagagaatgcctaaacgttgtgctactgaaagccacagtgctcccttcctgcaaggaccatcttcaatattcaagtaaggcttaaggaattcagtggattagtatatgctctcatctattttttcacattcctactatgaaaaaatttcaggcaatgccaataaagcaaaagtccctgtttgccctcatacagtctcactcccctcctcaaaggtagatcactgttatcaggtatgagctatctaggccttttttgaggtattcctatacaaatgtatttgaaaatctagaaatatatagcttgattttctttatataaatataaacattatttacatattttatttttcacttaagagaatgtcttagatctttcaaggttagtggcatcaatctcttatcttgtcaaaatatggttaaggtattacatattatgactgtgctgtagcatagggaattaacatttgactttttaatctgaatgtgttagagaatttacctgcagtattaaaatcacaagttattttctctccaaagccttcctaatcgtaagcaataactgaagtcttcagagcctttagataaatagagcctatttttctttttacttatttttatttttattttttggagacaaggtctcactctgacacccaggctggagtgcagcagcaccatcacagctcactgcagccttgacctcccaggctcaggtgatcttctcacctcagccttccaagtagctgggactacaggtgtgcaccaccacgtctggctagttactgtattttttgtagagatgggctcttgctgtgttgcccaggctggtctccaactcctgggctcaagtgatctgcccaccttggcctcccaaagtgctaggactacaggcatgagccaccgcacctggctgagtctgtttttcgcaaaatacttacacatatataaacgtagtgatttaaaataacttataattattaacccatttaccttaatttcttttaagttaggtaccaagaatgtatccacatttaaaaaattttaaaagaatgcacccattttcccatatagtatttcactataacacttaggcctcatggcaaccttctgaagaatgcatgacaatatttgtattttttagtttctaatccttaattcggtcagccagcaaacattagctgagtgcctgctctgccttgggaatgagactgcagatacagcggtgaacagtcacgaatactacatgttttttacagcctagcagtggagctaaatgaagtaaatgatgtaaataaagaaaccaaagctcaggaatttaaagtgatttgcaatagatgacgagcctagtagggaataggactaaagctggaatccaaatctccttacttctaatctggtatactttcttctaataacttgctgtttttgtgaggtacaaagaataatttaaaataaattattgcactaatagcattttaaaaattggaatcacgcctcttatccatcatggggctggttccatcttgttaaacagtctttatgatcatcctaacatttataagatattaattttggcaagaagaccaaaaatttttaattagggctattgctgattattattgttattaccaattttaaaatatctacaactagcttttagaaaccttaaaattgggccaggcacggtggcttgcacctgtaatcccagcactttgggaggccgaggcaggcggatcacaaggtcaggagatcaagaccatcctggccaacatggtgaaaccccgtctctactaaaaatacaaaaattagtcaggcgtggtggcgggcacctgtagtcccagctactcaggaggccgaggcaggagaatcgcttgaacacgggaggcggaggttgcagtgagccgagatcgcgccactgcactccagcctggaagacagagtgagactccttctcaaaaaaaaaaaaccttaaaattgatttgaagttgattatctttcataatcttctaattctcctttagaatgatccagtccattaaacactttgcagatgccagacctatgctctataaatccataaattaattcaatttattgaaagaagtagatatctataaaccccacactgaactggttaagcttaattgcaatcctagtccatcctagagagaaatcaaaataattgagaggttagggcattgtcgctgtgagaaagcttagaggtaacacattatatgttatctggagagaagaatgttaaatggaaacaaagtttatgaagaatttcttcaagtacctgaaggactttctgggaaattacaagatagcattcttaggttccatatgtctagaagacttttcataactgtaagcaacttttgcaaatggtttgggaacataaaactcttccagcatagaagaaaatgggtactattaacattcagatggttatgggaccatcataacagtttgatgtgatatgcaaaatgctacatccccaactatgaccctcagtatgacttttaaaggaattataagctccaaatactttttggagtataaacagtacttgactttttcacacatttgctaatacccttctcataagttttatttctttctgatgtttcagctaacactgagttaacagaagctaaataataataaaatgaagaacagatagtaaatatattgaaattgtcattcctggccgggtgtggtggcttacgcctataatcccagcactttgggaggccaaggcaggcagatcacgaggtcaggagatcgaggccatcctggccaacatggtgaaaccctgtctccactaaaaatacaaaaattagctgggtatggtgacgcatgcctataatcccagctactcgggagactgaggcataagaatcacttgaacccaggaggtcgcgccgctgcactccagcccggtgacagagcaagactccgtctcaaaaaaaaaaaaaagaaagaaaaagaaattgtcattcttaacataaattcccatatcactaaaatagatcagagaggtagaatgaaattttctctagcataggcatcattacatttaagccatctgagggctatgagcgtggcctgcaaagtcactctgagcaacacaaggtggagtttgaaagcagattcaaagccagaccactgggcttgagtcctcacatgcaagcatgtagtcttcaccatggagaagggggtttgcctttctcaaagcttttttcttttaaattaagaaaaagaactgatttatcagtctagtgtttcattttaaaaacatatgaaagggtgggtaacttgcagaagaaagtatttggagcctataattccattaaaagttataatggcggtcatagttggggaagcagcattttgcatattatatcaaaatgttatggtaccataaccatccaaatgttaatggtaccaatttcttctatcctagaaacatttcattttatgttgttgaaacataacaactatatcagctagattttttttctatgctttacctgctatggaaaatttgacacattctgctttactcttttgtttataggtgaatcacagaatgtatttttatgtattctgtagttcaatagccatggctgtttacttcatttaatttatttagcataaagacattatgaaaaggcctaaacatgagcttcacttccccactaactaattagcatctgttatttcttaaccgtaatgcctaggcctaacctcaaccaaccttccacaatcttgttcacagtcagagacccaaaaaagagtgttataagtggggtgtcactattgtgaaagtagtgctaatggtgttgaattggtacctatgattcttcttttgaattagattgtatgtttcatgatctcaacttacattactaaaattcaataaactgatcatttagatga

SEQ ID NO: 173672 - DNA, 1904 bp, Homo sapiens
  Payload ID: 14105
  Gene Symbol: RSPH3
  Gene Name: radial spoke 3 homolog (Chlamydomonas)
  ENST ID: ENST00000449822
  CDS Start-End: 232-1200
gatgcggcccccgcagctggtctctgtggtgctgggagcgagcccagtatagctcccacctcctgcgctggtaacctcccgtcccgcccgcctcccttgttgtcgcctctcctcgcgtcgcggaatccttgcccttggcactacttacatctctccgggtcccacaacaccttagcgcccacctgcttcaaagccaagctccaccgaaagcgaggcagtcagcccccggacatggcctcagcgctgactgatcgcacctctcgggccccgagcacctacacctacaccagccggccccgagcactgccctgccagcgcagccgttaccgggacagcctgacgcagccagatgaagaacctatgcattatggaaacataatgtatgacagaagggtaattcgaggtaacacttatgcactccagacagggccactgctctttgactttgatcttgaagttaaaccagtgttagaagttttggtggggaagacaattgagcagtctcttctggaagtaatggaagaagaagagctggctaacctgcgggccagtcagcgtgagtatgaagaactacggaatagtgaacgtgctgaagttcaacgacttgaagagcaagagaggcgacaccgagaagaaaaagaacggcgtaagaaacagcagtgggaaataatgcacaagcacaacgagacatcacaaaaaatcgccgcccgagcatttgcacagcgttacctggctgaccttctcccgtctgtttttggcagcctcagggatagtggctacttttatgatcccattgaaagagatattgagataggatttcttccatggctaatgaatgaagttgaaaaaaccatggaatatagcatggtgggaagaacagtgcttgacatgttgatccgtgaggtggttgaaaagaggctgtgtatgtatgagcatggggaagacacacatcagtctccagaacccgaggatgagcctggtggtcctggagcaatgacagagtcactggaggcctctgaattcctggagcagagcatgtcacagacacgggagctgcttttagatggaggctacctacaaagaacaacatatgacagaaggtcatcccaggaaaggaagtttatggaagagagagaactcttagggcaagatgaagaaacagcaatgaggaagtccttaggggaggaagaattgtcataggagggaagcttcaaagtcatgaaaccaatcaacagccaagtcagcaagcaatcaggtaatgatgtgcgagtcccctcaggttatagaaattatgttgtatttagtcagtatgtctttttgtgtaatggactgggccaatcaaatgtgataaaattaatttgagaatgaaacttaaattgaattcatttatttaatagaatattcaaaggctatattgtaattctaatgagaattatatttaattactagctttctattaccattatatgtaaccagcaaatatatttttccttagcccttctaattttgcgggttagttttttttagtaagtatgatatttaatgttcaatatcagtgctgtcagccatatagcttttcttctctataggaaaactatttcacctactgtaagagtgaatgcctagccaggcgtggtggctcacacctgtaatcccagcactttgggaggctgaggctggcagatcccctgaggtcgggagtttgagaccagccagaccaacaaggagaaaccccatctctgctaaaaatacaaaattagccaggcatggtggcgcatgcctgtaatcctagctacttgggaggctgaggcaggagaatcacttgaacctggggcggaggttgcggtgagccaagtttgcaccattgcactccagcctgggcaacaagagcaaaactccgtctc

SEQ ID NO: 173673 - DNA, 1430 bp, Homo sapiens
  Payload ID: 14106
  Gene Symbol: RSPH1
  Gene Name: radial spoke head 1 homolog (Chlamydomonas)
  Uniprot ID: Q8WYR4
  ENST ID: ENST00000291536
  CDS Start-End: 169-1098
tggctcctcccgcttcgtccgcgtcgcctgtccccgctccccatcttccgggctgggagggaggcgggaccggccgcgtctccatggcgacgcgggacgcggcggtggaggcggttgctacccacctgctagaggcgctgcggctgtgatccaggctggggcgagaccatgtcggacctgggctcggaggagttggaggaggagggagagaatgatattggggaatatgaggggggtcggaatgaggcaggcgaaaggcacggacgtgggagggcacggctacccaacggggacacctacgaagggagctacgaattcggtaaaagacatggccaggggatctacaaatttaaaaatggtgctcgatatatcggagaatatgttagaaataaaaagcacggtcaaggcacttttatatatccagatggatccagatatgaaggagagtgggcaaatgacctgcggcacggccatggcgtatactactacatcaataatgacacctacactggagagtggtttgctcatcaaaggcatgggcaaggcacctatttatacgcggagacgggcagtaagtatgttggcacctgggtgaacggacagcaggagggcacggccgagctcattcacctgaaccacaggtaccagggcaagttcttgaacaaaaatcctgttggccctggaaagtatgtatttgatgttgggtgtgaacaacatggtgaatatcgtttaacagatatggaaagaggagaagaggaagaggaggaagaattagtaactgttgttccaaaatggaaagctacccaaatcactgaattggccctgtggacaccaactctccccaaaaagccgacctctacggatggacctggccaagacgctccaggagctgagagtgcaggagaacccggggaggaggcccaggctctgctggagggcttcgagggtgagatggacatgaggcctggagatgaagatgcagacgtcctccgggaagagagccgggagtatgaccaggaggagttccgctatgacatggatgagggaaacattaattctgaagaagaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtccagaaagtggcagttgcagtgagtggagatcgcgccactgctctccagcctgggtggcagagcgagaccctgtctcaaaaaataaacaaaaacaaaatgcttctgtcagttaacaatctttattagagggtttttagtctttctttctcagctgtatgttaagttgattgacaaatgcaaataaacgtctttattatcctttctttctgaaa

SEQ ID NO: 173674 - DNA, 937 bp, Homo sapiens
  Payload ID: 14106
  Gene Symbol: RSPH1
  Gene Name: radial spoke head 1 homolog (Chlamydomonas)
  Uniprot ID: Q8WYR4
  ENST ID: ENST00000398352
  CDS Start-End: 1-816
atgtcggacctgggctcggaggagttggaggaggagggagagaatgatattggggggatctacaaatttaaaaatggtgctcgatatatcggagaatatgttagaaataaaaagcacggtcaaggcacttttatatatccagatggatccagatatgaaggagagtgggcaaatgacctgcggcacggccatggcgtatactactacatcaataatgacacctacactggagagtggtttgctcatcaaaggcatgggcaaggcacctatttatacgcggagacgggcagtaagtatgttggcacctgggtgaacggacagcaggagggcacggccgagctcattcacctgaaccacaggtaccagggcaagttcttgaacaaaaatcctgttggccctggaaagtatgtatttgatgttgggtgtgaacaacatggtgaatatcgtttaacagatatggaaagaggagaagaggaagaggaggaagaattagtaactgttgttccaaaatggaaagctacccaaatcactgaattggccctgtggacaccaactctccccaaaaagccgacctctacggatggacctggccaagacgctccaggagctgagagtgcaggagaacccggggaggaggcccaggctctgctggagggcttcgagggtgagatggacatgaggcctggagatgaagatgcagacgtcctccgggaagagagccgggagtatgaccaggaggagttccgctatgacatggatgagggaaacattaattctgaagaagaagaaactagacagtcagacctccaggactaagatgaagtgagccgagaggagatcgtatcataagaatgcttctgtcgttagccgggtgcagtgctgtgtgtatctagttccagctacttgagaggctgaggcaggaggattgcttgagtcc

SEQ ID NO: 173675 - DNA, 2923 bp, Homo sapiens
  Payload ID: 14107
  Gene Symbol: RSPH10B
  Gene Name: radial spoke head 10 homolog B (Chlamydomonas)
  Uniprot ID: P0C881
  ENST ID: ENST00000337579
  CDS Start-End: 89-2701
cagataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccacccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgccttccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatatgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatcttcatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccgtg

SEQ ID NO: 173676 - DNA, 3106 bp, Homo sapiens
  Payload ID: 14107
  Gene Symbol: RSPH10B
  Gene Name: radial spoke head 10 homolog B (Chlamydomonas)
  Uniprot ID: P0C881
  ENST ID: ENST00000404406
  CDS Start-End: 272-2884
gggacgccgagagcccggcaacacctcagcccgagcccggcgaggtctctgggctcctggagcgagagaggtggcatctcactacgtggcctaggctgatctccctctcctggactcacatgatcctcccaccttggcccttcaacgtgctgagatcgcaggtgtgagccaccacacccggccctgataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccacccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgccttccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatatgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatcttcatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccgtg

SEQ ID NO: 173677 - DNA, 3222 bp, Homo sapiens
  Payload ID: 14107
  Gene Symbol: RSPH10B
  Gene Name: radial spoke head 10 homolog B (Chlamydomonas)
  Uniprot ID: P0C881
  ENST ID: ENST00000405415
  CDS Start-End: 388-3000
gggacgccgagagcccggcaacacctcagcccgagcccggcgaggtctctgggctcctggagcgagagaggtggcatctcactacgtggcctaggctgatctccctctcctggactcacatgatcctcccaccttggcccttcaacgtgctgagatcgcaggtgtgagccaccacacccggccctggtaactaatttttcagactttgtcaggagaatgataatgacattgtgttgtaaaactgaaattttaactacaaatgaaaaccccaagtgtttggagacgtaatttttatttttcagataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccacccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgccttccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatatgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatcttcatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccgtg

SEQ ID NO: 173678 - DNA, 448 bp, Homo sapiens
  Payload ID: 14107
  Gene Symbol: RSPH10B
  Gene Name: radial spoke head 10 homolog B (Chlamydomonas)
  ENST ID: ENST00000455618
  CDS Start-End: 436-448
ggctcctggagcgaggtgagcgccccaggccgcggtcctgcgtacgccgggacagccatggcgactgggtcctgctccttcccggccggactgacgcggcctcccaggacccgagcacgtgcgtgatgggcgaggagggcctaggccgggcagaccagtgcagggagccgattcttcccggctcaccgtagacacaggagagagatggcctctccttaagcccaggagaacagaggaaacattaggaaacgcactgagaaacgaaattggcttgatttgtagttcacttatttgtagatcactgacagaagaccgaaaagctcgtagtaaaggcccctctaaatttagagataaaactcatcagtgctttgaaacaagcagctctgaaccaaagaaatcatttgattcaagtaaccattggatcttcccaaggcaatggtgaaagaaa

SEQ ID NO: 173679 - DNA, 646 bp, Homo sapiens
  Payload ID: 14107
  Gene Symbol: RSPH10B
  Gene Name: radial spoke head 10 homolog B (Chlamydomonas)
  ENST ID: ENST00000542644
  CDS Start-End: 607-646
gggacgccgagagcccggcaacacctcagcccgagcccggcgaggtctctgggctcctggagcgaggtgagcgccccaggccgcggtcctgcgtacgccgggacagccatggcgactgggtcctgctccttcccggccggactgacgcggcctcccaggacccgagcacgtgcgtgatgggcgaggagggcctaggccgggcagaccagtgcagggagccgattcttcccggctcaccgtagacacaggagagagatggcctctccttaagcccaggagaacagaggaaacattaggaaacgcactgagaaacgaaattggcttgatttgtagttcacttatttgtagatcactgacagaagaccgaaaagctcgtagtaaaggcccctctaaatttagagagaggtggcatctcactacgtggcctaggctgatctccctctcctggactcacatgatcctcccaccttggcccttcaacgtgctgagatcgcaggtgtgagccaccacacccggccctgataaaactcatcagtgctttgaaacaagcagctctgaaccaaagaaatcatttgattcaagtaaccattggatcttcccaaggcaatggtgaaagaaaagaaaaaagcagacaaaaaaggggaga

SEQ ID NO: 173680 - DNA, 2881 bp, Homo sapiens
  Payload ID: 14107
  Gene Symbol: RSPH10B
  Gene Name: radial spoke head 10 homolog B (Chlamydomonas)
  ENST ID: ENST00000539903
  CDS Start-End: 135-977
ttcagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccagcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagtaaccacctaagttcgatattggctttctatttacaggcactttgattttaattaaagaaaggcaggatattccagctgtgatatgcaaataatcaggactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatatgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatcttcatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccgtggtggtgtgtacatgtggttctagcttcttgggaggctgaggtgggaggattgcttgagctcaggaggttgaggctgcagtgagccattgcattccagcctgggtcacggagctggtggccagtgtaatctataaataggcagcaggagagagactcaacaccaaaccagaattttaaaaacttttaacaatttattagtcttattttccagtaaaatattcacataatgtcaaaagaatgaaatgatagcgatatagccaactacctttaattaattccacataaatatttaaaatctaaaaacctcagatcagcagaccgagtcgaaatgtgattcttcaaagcaagtattgctttacccttgtcctgaatgcagtccgtcatatgaccactaacttgcatgtgaccaaatgtttgcagagtgttttttagatatgctctcggtgagccgtcatccgtcaatccaagaagaagatgttgttgaactgcgttgcacaaagtttcttgacctcttctgcaacaaggacacaacagtgaggaaggaagaggcagtcacttaaaaggttacatgatatataattaaattcttcttgggt

SEQ ID NO: 173681 - DNA, 2923 bp, Homo sapiens
  Payload ID: 14108
  Gene Symbol: RSPH10B2
  Gene Name: radial spoke head 10 homolog B2 (Chlamydomonas)
  Uniprot ID: B2RC85
  ENST ID: ENST00000297186
  CDS Start-End: 89-2701
cagataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccagccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgcctgccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatacgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatctttatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccgtg

SEQ ID NO: 173682 - DNA, 3220 bp, Homo sapiens
  Payload ID: 14108
  Gene Symbol: RSPH10B2
  Gene Name: radial spoke head 10 homolog B2 (Chlamydomonas)
  Uniprot ID: B2RC85
  ENST ID: ENST00000403107
  CDS Start-End: 388-3000
gggacgccgagagcccggcaacacctcagcccgagcccggcgaggtctctgggctcctggagcgagagaggtggcatctcactacgtggcctaggctgatctccctctcctggactcacatgatcctcccaccttggcccttcaacgtgctgagatcgcaggtgtgagccaccacacccggccctggtaactaatttttcagactttgtcaggagaatgataatgacattgtgttgtaaaactgaaattttaactacaaatgaaaaccccaagtgtttggagacgtaatttttatttttcagataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccagccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgcctgccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatacgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatctttatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccg

SEQ ID NO: 173683 - DNA, 3106 bp, Homo sapiens
  Payload ID: 14108
  Gene Symbol: RSPH10B2
  Gene Name: radial spoke head 10 homolog B2 (Chlamydomonas)
  Uniprot ID: B2RC85
  ENST ID: ENST00000404077
  CDS Start-End: 272-2884
gggacgccgagagcccggcaacacctcagcccgagcccggcgaggtctctgggctcctggagcgagagaggtggcatctcactacgtggcctaggctgatctccctctcctggactcacatgatcctcccaccttggcccttcaacgtgctgagatcgcaggtgtgagccaccacacccggccctgataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaagaccgccaaaacgttcagcagaacgaagatgccagccaatacgaagagtccattctgaccaaactcatagtggaaagctatgaaggggaaaaggttcgtgggctgtatgagggagaaggcttcgcagcctttcaaggcggttgtacctatcgtggtatgttttcagaaggactcatgcatggacaggggacttatatttgggccgatggattaaaatatgagggcgactttgtgaagaatgtcccgatgaaccacggcgtgtacacgtggccggacggcagcatgtatgaaggcgaagtggtcaacggcatgaggaacggattcgggatgttcaagtgcagcacccagcctgtgtcctacatcggccactggtgcaatggcaagcggcacgggaagggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccaaaagagaagcccatccctcttcttgtgttttacaaaactgatgaccgagaacattcgtccaaatgcctgccagataaaaggcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatacgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatctttatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccgtg

SEQ ID NO: 173684 - DNA, 596 bp, Homo sapiens
  Payload ID: 14108
  Gene Symbol: RSPH10B2
  Gene Name: radial spoke head 10 homolog B2 (Chlamydomonas)
  ENST ID: ENST00000418406
  CDS Start-End: 420-596
gagagcccggcaacacctcagcccgagcccggcgaggtctctgggctcctggagcgaggtgagcgccccaggccgcggtcctgcctacgccgggacagccatggcgactgggtcctgctccttcccggccggactgacgcggcctcccaggacccgagcacatcactgacagaagaccgaaaagctcgtagtaaaggcccctctaaatttagagagaggtggcatctcactacgtggcctaggctgatctccctctcctggactcacatgatcctcccaccttggcccttcaacgtgctgagatcgcaggtgtgagccaccacacccggccctgataaaactcatcagtgctttgaaacaagcagctctgaaccaaagaaatcatttgattcaagtaaccattggatcttcccaaggcaatggtgaaagaaaagaaaaaagcagacaaaaaaggggagaagtctgcccgctctccctcatctctctctgataatctagacttttccaaacaagatggcaacaccactaggcaagagatgtccccagctggtgtcccattgctgggaatgcagctcaacgaagtgaaacccaaaaaa

SEQ ID NO: 173685 - DNA, 627 bp, Homo sapiens
  Payload ID: 14108
  Gene Symbol: RSPH10B2
  Gene Name: radial spoke head 10 homolog B2 (Chlamydomonas)
  ENST ID: ENST00000435395
  CDS Start-End: 599-627
gagagcccggcaacacctcagcccgagcccggcgaggtctctgggctcctggagcgaggtgagcgccccaggccgcggtcctgcctacgccgggacagccatggcgactgggtcctgctccttcccggccggactgacgcggcctcccaggacccgagcacgtgcgtgatgggcgaggagggcctaggccgggcagaccagtgcagggagccgattcttctcggctcaccgtagacacaggagagagatggcctctccttaagcccaggagaacagaggaaacattaggaaacgcactgagaaacgaaattggcttgatttgtagttcacttatttgtagatcactgacagaagaccgaaaagctcgtagtaaaggcccctctaaatttagagagaggtggcatctcactacgtggcctaggctgatctccctctcctggactcacatgatcctcccaccttggcccttcaacgtgctgagatcgcaggtgtgagccaccacacccggccctgataaaactcatcagtgctttgaaacaagcagctctgaaccaaagaaatcatttgattcaagtaaccattggatcttcccaaggcaatggtgaaagaaaagaaaaaagcagacaa

SEQ ID NO: 173686 - DNA, 2880 bp, Homo sapiens
  Payload ID: 14108
  Gene Symbol: RSPH10B2
  Gene Name: radial spoke head 10 homolog B2 (Chlamydomonas)
  ENST ID: ENST00000485920
  CDS Start-End: 1-972
ggctccatttattacaatcaagagggtacgtgttggtacgagggagactgggtacaaaacatcaaaaagggctggggaataagatgttataaatctggaaatatatacgaaggccagtgggaagacaacatgcgccacggggaggggaggatgaggtggctgaccaccaacgaagagtacaccgggcggtgggagaggggcatccagaatggctttggaacacacacatggtttctaaagagaatccgcagttcccagtatcctttgagaaatgaatacataggggagtttgtaaatggatatcgtcacggacgtggcaagttttattatgccagtggagccatgtatgatggagaatgggtttccaataagaaacatggcatgggccgattaactttcaagaacgggcgtgtgtacgaaggcgcattctccaatgaccacatagctgggtttccggatcttgaagttgaattcatcagctgcctggacctgtcttcaggagttgccccaagactgtccaggagcgccgaactgatcagaaagcttgatggcagtgaaagtcattctgtgttgggatcgagcattgagctggatctaaatttgctcctggacatgtaccctgagacagtccaacctgaagaaaagaagcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtgccaataatgacataccagttgaagaaatccattctccatttacaacaatacttttgagaacatttttgaattacctcctgcatttggcgtaccacatttatcatgaagaattccagcaatttattccgtgagcaacagcggacgctctactctatgagttacatgaataagtgctgggagatttatctcgcttactgcagacccagtgcagcgcctccccacgagcctacgatgaagatgagacacttcctctggatgctgaaagtaaccacctaagttcgatattggctttctatttacaggcactttgattttaattaaagaaaggcaggatattccagctgtgatatgcaaattatcaggactttaaaatgataaataaagaattaacagcagctacatttatggaggtcatagcagaggataatcgtttcatatatgatggaattgacagcaactttgaacctgagctggttttcctggaattctttgaagctctcttaagctttgcattcatctgtgttactgaccaaatgactaaatcctatacaaatgttccagctgatgatgtgtctggaaataaacatgaaactatttatacaatactaaatcaggacgcccagaacaagagtcccagcgcggtcatgagccacgaatcggatgctgctcactctgacagtgccaggtcatcttccagcaagttagaactctcgcctgatgttaacaaaataaggaaatcagagcccaagatcaagaagtctgtaagtcatgaaagagtctccaaaatgaattttaaattgactggaaaagggatcacctttttctcatctgagagcaagaaatatgagagacccaaggatgatcgagaggaagagttcaacacgtgggtcaataatacgtacgtcttctttgtgaacacgctctttcatgcgtataaacgtgaagaagctatcaaggagaaaataagggcagacaggttacgtagcacagcacaggcccagcagcggaagatggaagatgacgaactggaagcaaggctgaacatctttatcttgagagaggaagaggccaagagacatgactatgaggtggacatcacagtgctcaaggagccggcagacgtgtcatcctctcacctcatactggaccctcccaaggaggatgtgaccgtgtccccatccagcaagaccatcaccagcaagaagaagaaaaagtagagagacacgaggacacacacacaggcttaggatggcacgtgctgtaagatttcctgagcattacagttcttagcactgaactcgtcacagtgttttaacataccccttggcccactgcatctcaggtttcctacatggctggattacgggagttcgagaccagcctgggcaacatagtgagacccccccatctctgcaaaattaaaacatcagccgaccgtggtggtgtgtacatgtggttctagcttcttgggaggctgaggtgggaggattgcttgagctcaggaggttgaggctgcagtgagccattgcattccagcctgggtcacggagctggtggccagtgtaatctataaataggcagcaggagagagactcaacaccaaaccagaattttaaaaacttttaacaatttattagtcttattttccagtaaaatattcaaataatgtcaaaagaatgaaatgatagcgatatagccaactacctttaattaattccacataaatatttaaaatctaaaaacctcagatcagcagaccgagtcgaaatctgattcttcaaagcaagtattgctttacccttgtcctgaatgcagtccgtcatatgaccactaacttgcatgtgaccaaatgtttgcagagtgttttttagatatgctctcggtgagccgtcatccgtcaatccaagaagaagatgttgttgaactgcgttgcacaaagtttcttgacctcttctgcaacaaggacacaacagtgaggaaggaagaggcagtcacttaaaaggttacataatatataattaaattcttcttgggtaaaa

SEQ ID NO: 173687 - DNA, 1291 bp, Homo sapiens
  Payload ID: 14109
  Gene Symbol: RSPH14
  Gene Name: radial spoke head 14 homolog (Chlamydomonas)
  Uniprot ID: Q9UHP6
  ENST ID: ENST00000216036
  CDS Start-End: 198-1244
gtttgcgcctgcgcagtgggtgctgattatgtcgaccgcggcgccgcggacgctgctggagtcgcctggcaacgatgtcgcctggcaactgaataggttggccagtggcgcgggctactggaagcagaaagggctgcggaggcagtgagtggtttctgcagagcttcatttggaaaggcctctgtagttggggaaagatggcccattcccagaactccttggagcttcccattaacatcaatgccacccagattaccactgcctatggccatcgggccctgcccaagctgaaggaggagctgcagtcagaggacctccagacgaggcagaaagccctcatggccttgtgtgacctcatgcatgaccccgagtgtatctacaaggccatgaacataggctgtatggagaacctgaaagctttgctgaaggatagcaacagtatggtgcgcataaagaccaccgaggtgctccacatcacggcaagccatagcgtgggcagatacgcctttctagagcacgacatcgtccttgccctgtccttcctgctgaatgaccccagcccagtctgccgggggaacctgtacaaggcatacatgcagctggtccaggtgcctagaggggcccaagagatcatcagcaaaggtctgatttcctcactggtatggaagctgcaggtggaggtggaggaggaggagttccaggagttcatcctggacacactggtcctctgcctgcaggaggatgccaccgaggccctgggcagcaatgtggtgcttgtcctgaagcagaagctcctcagcgccaaccagaacatccgcagcaaggccgcccgtgcgctccttaatgtcagcatatctcgagagggcaagaaacaggtgtgtcattttgacgtcatccccatcctggtccatctgctgaaagacccagtggagcatgtgaagtctaacgctgccggtgccctgatgttcgccacagtgatcactgaagggaagtatgcggccctggaggcacaagccatcggcctgctcctggagctgctgcactcccccatgaccatagcgcgcctgaatgccaccaaggcccttaccatgctggcagaggcccccgagggccgcaaggccctgcagacgcacgtgcccactttccgtgccatggaggtggagacttacgaaaagcctcaagtggccgaagccttacagcgggcagcccggatcgccatcagtgtcatcgagttcaaaccctgagcccttcattcacctctgtgagtgaataaatgtgctaagtctcttta

SEQ ID NO: 173688 - DNA, 519 bp, Homo sapiens
  Payload ID: 14109
  Gene Symbol: RSPH14
  Gene Name: radial spoke head 14 homolog (Chlamydomonas)
  ENST ID: ENST00000406876
  CDS Start-End: 93-419
tgctgtctgaatatcatatgcctggcttctagagctcacgtgagtggtttctgcagagcttcatttggaaaggcctctgtagttggggaaagatggcccattcccagaactccttggagcttcccattaacatcaatgccacccagattaccactgcctatggccatcgggccctgcccaagctgaaggaggagctgcagtcagaggacctccagacgaggcagaaagccctcatggccttgtgtgacctcatgcatgaccccgagtgtatctacaaggccatgaacataggctgtatggagaacctgaaagctttgctgaaggatagcaacagtatggtgcgcataaagaccaccgaggtgctccacatcacggcaagccatagcgtgggcagaagtagtgacaggaagggggaatgaggatagcagccctgggcttggcatcttgtcaccttgaggagttaatttgcatgacatcccacggacaagagagcttcctggcagcctgttccctgccctc

SEQ ID NO: 173689 - DNA, 509 bp, Homo sapiens
  Payload ID: 14109
  Gene Symbol: RSPH14
  Gene Name: radial spoke head 14 homolog (Chlamydomonas)
  ENST ID: ENST00000452757
  CDS Start-End: 1-204
cagacgaggcagaaagccctcatggccttgtgtgacctcatgcatgaccccgagtgtatctacaaggccatgaacataggctgtatggagaacctgaaagctttgctgaaggatagcaacagtatggtgcgcataaagaccaccgaggtgctccacatcacggcaagccatagcgtgggcagtagtgacaggaagggggaatgaggatagcagccctgggcttggcatcttgtcaccttgaggagttaatttgcatgacatcccacggacaagagagcttcctggcagcctgttccctgccctcttgcttgcctctggtgaggaggcacacaggcaaacacaactgactatcaaagcatgagagacatggagtgggtgactagacacggaccaaggaagcccccgtggtcagggaagacccctgcaacttgtgtgtccaacggtgactttctttttccagacgattcaaaacacaccataagtgaaaataaataaataaataaaataaa

SEQ ID NO: 173690 - DNA, 695 bp, Homo sapiens
  Payload ID: 14109
  Gene Symbol: RSPH14
  Gene Name: radial spoke head 14 homolog (Chlamydomonas)
  ENST ID: ENST00000439064
  CDS Start-End: 1-202
gaaggatagcaacagtatggtgcgcataaagaccaccgaggtgctccacatcacggcaagccatagcgtgggcagatacgcctttctagagcacgacatcgtccttgccctgtccttcctgctgaatgaccccagcccagtctgccgggggaacctgtacaaggcatacatgcagctggtccaggtgcctagaggaacctgaggaataagcgagggtctagtcccctcattcttggagtgtggagacaggggacttgctgctctcaaccagtcctcttacaatgattgtgacctatttaaagcattcagagaagtacagagatggtgataaggaacattggataccaccagccagctttgccaaatctttacattctatatccatattttatacttgcttgaaatttttatttgaagaaatcataggtacagtccaagcaccctgtgaacctccccccacccagagcactcttcctcctgcctttccttgagctactaataatctggtgactatgtccccaaaatgcatatctttatattttaccacagatataattacatatggacgatatataatcttgttttgcatgttttaaaactatgtaagtggatcttgctgtatgtatccctctgttacttccaaaaccttaaaaaacctaaataacattagagatttatagaaattttgagatgaa

SEQ ID NO: 173691 - DNA, 323 bp, Homo sapiens
  Payload ID: 14109
  Gene Symbol: RSPH14
  Gene Name: radial spoke head 14 homolog (Chlamydomonas)
  ENST ID: ENST00000421213
  CDS Start-End: 1-222
cgggggaacctgtacaaggcatacatgcagctggtccaggtgcctagagcagaaaaccccaccattaacaagaggacactgcagaggcttatgtacaacacgtgtcccgcgaggctggcgcaggactgccactcactccaaaatttctttggagcagagagacagatcgtccagataacaacttttacactcagcaagccagacacaaaaaagaccacctgaaaaaaaatatgttttgaaaatctgcatttaaaaaagaatactcaactgcatttgaaattttctggatttttttctgcgaaacaccacgagatttggccaaa

SEQ ID NO: 173692 - DNA, 2825 bp, Homo sapiens
  Payload ID: 14110
  Gene Symbol: RSPH4A
  Gene Name: radial spoke head 4 homolog A (Chlamydomonas)
  Uniprot ID: Q5TD94
  ENST ID: ENST00000229554
  CDS Start-End: 138-2288
aggacgcagcaactcacagagcaaccaggacccagaaatcgcttaagagaccgcggcaaagtaacttaactgagttgccttcttccatattttcacgcccctttcatccagaacattttttttcttgaactgcttccatggaggactcaacctccccgaagcaagaaaaagaaaaccaagaagaactaggggaaacaaggcggccatgggaaggaaagacagcagcttctccccaatattctgagcctgagtcgtctgagcccttggaggcgaagcaggggccagaaactggacgccagtcccgaagcagccgtccttggagcccgcagtctagagccaagacgcctctgggtggccccgcgggaccagaaacatcatcacctgctcctgtctctccgcgggagccctcttcctctccttctcccctggctccggccagacaagacctcgcggcaccacctcagtcggacaggaccacgagtgtgattcctgaagctgggacaccttatcctgatcctttggaacaatcatctgataaaagagaatcaactcctcatcacacaagccagtcagaaggaaacacctttcaacagtctcagcaacccaaaccccacctgtgtggacgaagggacgtgagctataacaacgctaaacagaaagagctgagatttgacgtttttcaggaggaagactcaaacagtgactatgatttacagcagccggcgcctgggggctctgaagtggcccccagcatgcttgagatcaccattcagaatgctaaggcttacctgctgaagactagcagcaattcgggctttaatctatatgatcatctttctaatatgttgaccaagatattaaatgagcgtcctgaaaatgctgttgacatctttgaaaatattagccaagatgtgaagatggcacattttagtaaaaaatttgatgcactacaaaatgagaatgagttgcttccaacatatgaaatagcagaaaagcaaaaggctctttttctccagggacatttggaaggagttgaccaagaattggaagatgaaatagcagaaaacgctcttccaaatgtaatggagtcagctttttattttgaacaagctggagttggtttgggcacagatgagacataccgcatatttcttgccctcaagcagcttactgatacccacccaatccaaagatgccgcttctggggaaagatcttgggtctggaaatgaattatattgtagctgaagtggaatttcgtgagggggaagatgaagaggaagtggaagaggaagatgtagctgaagagagggacaatggagaaagtgaagctcatgaagatgaggaagatgaattaccaaagtccttttacaaggccccacaggctataccaaaagaagaaagtagaacaggtgccaacaaatatgtctattttgtttgcaatgaaccaggaagaccatgggtgaagttaccaccagttatacctgcacaaattgttattgcaagaaaaatcaagaaatttttcactgggcgattggatgctcccatcataagctacccacctttcccaggaaatgagagtaattatttacgagcacaaattgcccgaatttcagcaggaacccacgtcagtcctctaggattttatcagtttggtgaagaggaaggagaggaggaggaagaggcagaaggtgggcgaaatagctttgaggaaaaccctgattttgaaggcatccaagtgattgatctagtagaatccctatccaattgggttcatcatgtacagcatattctctctcagggtcgctgtaattggttcaactccatacaaaaaaatgaggaagaagaagaggaagaagatgaagaaaaagacgattctgactacatagaacaggaagtggggcttcctcttttgacaccaatctctgaagatttagagattcagaatatacccccctggacaacacggttatcctcaaatctcattccacaatatgctattgcagtccttcaatccaacctttggcctggagcatatgccttctccaatggcaaaaagtttgaaaatttctacataggctggggtcataagtatagtccagacaattatacacccccagttccaccaccagtttatcaagaataccccagtggaccagaaattacagaaatggatgatcctagtgtggaggaggagcaggctttcagggctgcacaagaagcagttctactcgcagctgagaatgaagaatctgaggaagatgaagatgaggaagatgattatgactaataaacataaaattagcctggttttatgtgacactgatacacacacaccccttatatgggactaattttacacttttctgtgttatgtgtgtatatacatacacatgtaagaaattattcaactgcaaaatctcaatcttgaaaatcaagcttgaaatttcataggtagaaatattagcatttttattgaaagatactcacaggattttccagaggctaaataacatgcaattgcataattgttctgagggttatggataatggaatatgtgtttgtacattcctgtttttaaaagggctcaggtttcacatggtccaggtgaggtaaaacaattaaaataaataaataaatggtctcaggtttaatttgtaatacgacaaacactggaagatataacccacaggaaattcttggaaacatcaatactttttaaagagtgtcaaggggtatgaagacaaaaaatattgatagtcactagagtaatgtattcttaacctttgtaagaactgatctcagcatgtattcttaaacctttgt

SEQ ID NO: 173693 - DNA, 1410 bp, Homo sapiens
  Payload ID: 14110
  Gene Symbol: RSPH4A
  Gene Name: radial spoke head 4 homolog A (Chlamydomonas)
  Uniprot ID: Q5TD94
  ENST ID: ENST00000368580
  CDS Start-End: 1-1410
atggaggactcaacctccccgaagcaagaaaaagaaaaccaagaagaactaggggaaacaaggcggccatgggaaggaaagacagcagcttctccccaatattctgagcctgagtcgtctgagcccttggaggcgaagcaggggccagaaactggacgccagtcccgaagcagccgtccttggagcccgcagtctagagccaagacgcctctgggtggccccgcgggaccagaaacatcatcacctgctcctgtctctccgcgggagccctcttcctctccttctcccctggctccggccagacaagacctcgcggcaccacctcagtcggacaggaccacgagtgtgattcctgaagctgggacaccttatcctgatcctttggaacaatcatctgataaaagagaatcaactcctcatcacacaagccagtcagaaggaaacacctttcaacagtctcagcaacccaaaccccacctgtgtggacgaagggacgtgagctataacaacgctaaacagaaagagctgagatttgacgtttttcaggaggaagactcaaacagtgactatgatttacagcagccggcgcctgggggctctgaagtggcccccagcatgcttgagatcaccattcagaatgctaaggcttacctgctgaagactagcagcaattcgggctttaatctatatgatcatctttctaatatgttgaccaagatattaaatgagcgtcctgaaaatgctgttgacatctttgaaaatattagccaagatgtgaagatggcacattttagtaaaaaatttgatgcactacaaaatgagaatgagttgcttccaacatatgaaatagcagaaaagcaaaaggctctttttctccagggacatttggaaggagttgaccaagaattggaagatgaaataggtcgctgtaattggttcaactccatacaaaaaaatgaggaagaagaagaggaagaagatgaagaaaaagacgattctgactacatagaacaggaagtggggcttcctcttttgacaccaatctctgaagatttagagattcagaatatacccccctggacaacacggttatcctcaaatctcattccacaatatgctattgcagtccttcaatccaacctttggcctggagcatatgccttctccaatggcaaaaagtttgaaaatttctacataggctggggtcataagtatagtccagacaattatacacccccagttccaccaccagtttatcaagaataccccagtggaccagaaattacagaaatggatgatcctagtgtggaggaggagcaggctttcagggctgcacaagaagcagttctactcgcagctgagaatgaagaatctgaggaagatgaagatgaggaagatgattatgactaa

SEQ ID NO: 173694 - DNA, 2704 bp, Homo sapiens
  Payload ID: 14110
  Gene Symbol: RSPH4A
  Gene Name: radial spoke head 4 homolog A (Chlamydomonas)
  Uniprot ID: Q5TD94
  ENST ID: ENST00000368581
  CDS Start-End: 146-1948
atggagataggacgcagcaactcacagagcaaccaggacccagaaatcgcttaagagaccgcggcaaagtaacttaactgagttgccttcttccatattttcacgcccctttcatccagaacattttttttcttgaactgcttccatggaggactcaacctccccgaagcaagaaaaagaaaaccaagaagaactaggggaaacaaggcggccatgggaaggaaagacagcagcttctccccaatattctgagcctgagtcgtctgagcccttggaggcgaagcaggggccagaaactggacgccagtcccgaagcagccgtccttggagcccgcagtctagagccaagacgcctctgggtggccccgcgggaccagaaacatcatcacctgctcctgtctctccgcgggagccctcttcctctccttctcccctggctccggccagacaagacctcgcggcaccacctcagtcggacaggaccacgagtgtgattcctgaagctgggacaccttatcctgatcctttggaacaatcatctgataaaagagaatcaactcctcatcacacaagccagtcagaaggaaacacctttcaacagtctcagcaacccaaaccccacctgtgtggacgaagggacgtgagctataacaacgctaaacagaaagagctgagatttgacgtttttcaggaggaagactcaaacagtgactatgatttacagcagccggcgcctgggggctctgaagtggcccccagcatgcttgagatcaccattcagaatgctaaggcttacctgctgaagactagcagcaattcgggctttaatctatatgatcatctttctaatatgttgaccaagatattaaatgagcgtcctgaaaatgctgttgacatctttgaaaatattagccaagatgtgaagatggcacattttagtaaaaaatttgatgcactacaaaatgagaatgagttgcttccaacatatgaaatagcagaaaagcaaaaggctctttttctccagggacatttggaaggagttgaccaagaattggaagatgaaatagcagaaaacgctcttccaaatgtaatggagtcagctttttattttgaacaagctggagttggtttgggcacagatgagacataccgcatatttcttgccctcaagcagcttactgatacccacccaatccaaagatgccgcttctggggaaagatcttgggtctggaaatgaattatattgtagctgaagtggaatttcgtgagggggaagatgaagaggaagtggaagaggaagatgtagctgaagagagggacaatggagaaagtgaagctcatgaagatgaggaagatgaattaccaaagtccttttacaaggccccacaggctataccaaaagaagaaagtagaacaggtgccaacaaatatgtctattttgtttgcaatgaaccaggaagaccatgggtgaagttaccaccagttatacctgcacaaattgttattgcaagaaaaatcaagaaatttttcactgggcgattggatgctcccatcataagctacccacctttcccaggaaatgagagtaattatttacgagcacaaattgcccgaatttcagcaggaacccacgtcagtcctctaggattttatcagtttggtgaagaggaaggagaggaggaggaagaggcagaaggtgggcgaaatagctttgaggaaaaccctgattttgaaggcatccaagtgattgatctagtagaatccctatccaattgggttcatcatgtacagcatattctctctcagagattcagaatatacccccctggacaacacggttatcctcaaatctcattccacaatatgctattgcagtccttcaatccaacctttggcctggagcatatgccttctccaatggcaaaaagtttgaaaatttctacataggctggggtcataagtatagtccagacaattatacacccccagttccaccaccagtttatcaagaataccccagtggaccagaaattacagaaatggatgatcctagtgtggaggaggagcaggctttcagggctgcacaagaagcagttctactcgcagctgagaatgaagaatctgaggaagatgaagatgaggaagatgattatgactaataaacataaaattagcctggttttatgtgacactgatacacacacaccccttatatgggactaattttacacttttctgtgttatgtgtgtatatacatacacatgtaagaaattattcaactgcaaaatctcaatcttgaaaatcaagcttgaaatttcataggtagaaatattagcatttttattgaaagatactcacaggattttccagaggctaaataacatgcaattgcataattgttctgagggttatggataatggaatatgtgtttgtacattcctgtttttaaaagggctcaggtttcacatggtccaggtgaggtaaaacaattaaaataaataaataaatggtctcaggtttaatttgtaatacgacaaacactggaagatataacccacaggaaattcttggaaacatcaatactttttaaagagtgtcaaggggtatgaagacaaaaaatattgatagtcactagagtaatgtattcttaacctttgtaagaactgatctcagcatgtattcttaaacctttgtaattacc

SEQ ID NO: 173695 - DNA, 2456 bp, Homo sapiens
  Payload ID: 14111
  Gene Symbol: RSPH6A
  Gene Name: radial spoke head 6 homolog A (Chlamydomonas)
  Uniprot ID: Q9H0K4
  ENST ID: ENST00000221538
  CDS Start-End: 144-2297
caccctggcccgctccccgcgccctccacgggtaacggccccctctctcggtgctcagaaaccggcggtgtcgacaggtggctctcgcttggcctccttgtctgcaagcctttctcctagagatctgtgcctcctggcgaaccatgggagacctgccgccctaccctgagcgccctgcccagcagcctccgggccggaggacttctcaggcctcccagaggcggcacagtcgggaccaagctcaggccctggcagcggaccccgaggagaggcagcagatacctccagacgcccagcgaaacgcccctggttggtcacagaggggcagcctgtcccaacaggagaacttgctgatgccccaggtcttccaggctgaggaagcccggctgggtggcatggagtacccatctgtgaacacgggctttccctcagagttccagcctcagccttactctgatgaaagcaggatgcaggtcgccgagctcaccaccagcctaatgctgcagcggctccagcagggccaaagcagcctgttccagcaactggaccccaccttccaggagcccccagtcaaccccttgggccagttcaacctctaccagacagaccagttctctgaaggtgcccagcacgggccttacataagggatgaccctgcccttcagttcttgccctctgagctgggcttcccacactacagtgcccaggtgcctgagcccgagcctctggagctggccgtgcagaacgccaaggcctacctgctgcagaccagcatcaattgcgacctcagcctgtacgagcacctggtgaatctgctgaccaagatcctgaaccagcggcctgaggaccccttgtctgtcctggagtctctgaaccgcaccacgcagtgggagtggttccaccccaagctggacacgctgcgggacgaccccgagatgcagcccacctacaagatggcggagaaacagaaggcgctgttcacccggagtggaggcggcactgaaggcgaacaggagatggaggaggaggtgggggagacaccagtgcccaacatcatggagactgccttctacttcgagcaggccggcgtcggcctgagctcggacgagagcttccgcattttcctggccatgaaacagctggtggagcagcagcccatccacacctgtcgcttctggggcaagatcctgggaatcaaacgcagctacctggtggccgaggtggaattccgggagggcgaggaggaggcagaggaggaggaggtggaggagatgacggaaggtggcgaggtcatggaggcgcacggcgaggaggagggcgaggaggacgaggagaaggccgtggacatcgtccctaagtccgtatggaagccgccgcccgtgatccccaaggaggagagccgctcaggcgccaacaagtacctgtactttgtgtgcaacgagccgggcctgccatggacgcggctgccccacgtcactccagcccagatcgtgaacgcccgaaagatcaagaagttcttcacaggctacctggacacgccagtcgtcagctacccacccttcccgggcaacgaggccaactacctgcgggcccagatagcccgcatctcggccgccacgcaggtcagcccgctgggcttctaccagtttagtgaggaggagggcgacgaggaggaggaaggtggtgctgggcgcgactcctacgaggagaacccggacttcgagggcatccccgtgctggagctggtcgactccatggccaactgggtgcatcacacacagcacatcctgccgcagggccgctgcacttgggtgaaccctttgcagaagacagaggaggaggaggacctgggggaggaggaagagaaggcagatgaggggccagaggaggtggagcaggaggttggccccccactgctaacgccactttcagaagatgcagaaatcatgcacctggcaccctggaccacccgcctgtcctgcagcctctgcccgcagtactcagtggccgttgtgcgctccaacctctggcccggggcctatgcctatgccagtggcaaaaagtttgagaacatctacatcggctggggtcacaagtacagccccgagagcttcaacccggccctgccagcccccattcaacaagagtaccccagtggcccagagatcatggagatgagtgaccccacagtggaagaggagcaggctctgaaagcagcccaggaacaagccctgggagccacagaggaggaggaggagggcgaggaggaggaggagggcgaggagacagatgactgaggcccaccctctagccactttccccaagcaggtagatagcaaatttccccttagaggtagttagcatggattatattttcactatgtgcttcctgtccccagagggcagggatagaaaaggaaggcaactgcttcaaataaaattcctccacggcatta

SEQ ID NO: 173696 - DNA, 1751 bp, Homo sapiens
  Payload ID: 14111
  Gene Symbol: RSPH6A
  Gene Name: radial spoke head 6 homolog A (Chlamydomonas)
  ENST ID: ENST00000600188
  CDS Start-End: 234-1595
agcaccaggcacagggccaggcacatgggagccagctcagtgagctgagtgagtgaggtccctctcctcccactcctcctgcgggaggcaggtacgagcacctggtgaatctgctgaccaagatcctgaaccagcggcctgaggaccccttgtctgtcctggagtctctgaaccgcaccacgcagtgggagtggttccaccccaagctggacacgctgcgggacgaccccgagatgcagcccacctacaagatggcggagaaacagaaggcgctgttcacccggagtggaggcggcactgaaggcgaacaggagatggaggaggaggtgggggagacaccagtgcccaacatcatggagactgccttctacttcgagcaggccggcgtcggcctgagctcggacgagagcttccgcattttcctggccatgaaacagctggtggagcagcagcccatccacacctgtcgcttctggggcaagatcctgggaatcaaacgcagctacctggtggccgaggtggaattccgggagggcgaggaggaggcagaggaggaggaggtggaggagatgacggaaggtggcgaggtcatggaggcgcacggcgaggaggagggcgaggaggacgaggagaaggccgtggacatcgtccctaagtccgtatggaagccgccgcccgtgatccccaaggaggagagccgctcaggcgccaacaagtacctgtactttgtgtgcaacgagccgggcctgccatggacgcggctgccccacgtcactccagcccagatcgtgaacgcccgaaagatcaagaagttcttcacaggctacctggacacgccagtcgtcagctacccacccttcccgggcaacgaggccaactacctgcgggcccagatagcccgcatctcggccgccacgcaggtcagcccgctgggcttctaccagtttagtgaggaggagggcgacgaggaggaggaaggtggtgctgggcgcgactcctacgaggagaacccggacttcgagggcatccccgtgctggagctggtcgactccatggccaactgggtgcatcacacacagcacatcctgccgcagggccgctgcacttgggtgaaccctttgcagaagacagaggaggaggaggacctgggggaggaggaagagaaggcagatgaggggccagaggaggtggagcaggaggttggccccccactgctaacgccactttcagaagatgcagaaatcatgcacctggcaccctggaccacccgcctgtcctgcagcctctgcccgcagtactcagtggccgttgtgcgctccaacctctggcccggggcctatgcctatgccagtggcaaaaagtttgagaacatctacatcggctggggtcacaagtacagccccgagagcttcaacccggccctgccagcccccattcaacaagagtaccccagtggcccagagatcatggagatgagtgaccccacagtggaagaggagcaggctctgaaagcagcccaggaacaagccctgggagccacagaggaggaggaggagggcgaggaggaggaggagggcgaggagacagatgactgaggcccaccctctagccactttccccaagcaggtagatagcaaatttccccttagaggtagttagcatggattatattttcactatgtgcttcctgtccccagagggcagggatagaaaaggaaggcaactgcttcaaataaaattcctccacggca

SEQ ID NO: 173697 - DNA, 2306 bp, Homo sapiens
  Payload ID: 14111
  Gene Symbol: RSPH6A
  Gene Name: radial spoke head 6 homolog A (Chlamydomonas)
  ENST ID: ENST00000597055
  CDS Start-End: 53-2083
gcctccttgtctgcaagcctttctcctagagatctgtgcctcctggcgaaccatgggagacctgccgccctaccctgagcgccctgcccagcagcctccgggccggaggacttctcaggcctcccagaggcggcacagtcgggaccaagctcaggccctggcagcggaccccgaggagaggcagcagatacctccagacgcccagcgaaacgcccctggttggtcacagaggggcagcctgtcccaacaggagaacttgctgatgccccaggtcttccaggctgaggaagcccggctgggtggcatggagtacccatctgtgaacacgggctttccctcagagttccagcctcagccttactctgatgaaagcaggatgcaggtcgccgagctcaccaccagcctaatgctgcagcggctccagcagggccaaagcagcctgttccagcaactggaccccaccttccaggagcccccagtcaaccccttgggccagttcaacctctaccagacagaccagttctctgaaggtgcccagcacgggccttacataagggatgaccctgcccttcagttcttgccctctgagctgggcttcccacactacagtgcccaggtgcctgagcccgagcctctggagctggccgtgcagaacgccaaggcctacctgctgcagaccagcatcaattgcgacctcagcctgtacgagcacctggtgaatctgctgaccaagatcctgaaccagcggcctgaggaccccttgtctgtcctggagtctctgaaccgcaccacgcagtgggagtggttccaccccaagctggacacgctgcgggacgaccccgagatgcagcccacctacaagatggcggagaaacagaaggcgctgttcacccggagtggaggcggcactgaaggcgaacaggagatggaggaggaggtgggggagacaccagtgcccaacatcatggagactgccttctacttcgagcaggccggcgtcggcctgagctcggacgagagcttccgcattttcctggccatgaaacagctggtggagcagcagcccatccacacctgtcgcttctggggcaagatcctgggaatcaaacgcagctacctggtggccgaggtggaattccgggagggcgaggaggaggcagaggaggaggaggtggaggagatgacggaaggtggcgaggtcatggaggcgcacggcgaggaggagggcgaggaggacgaggagaaggccgtggacatcgtccctaagtccgtatggaagccgccgcccgtgatccccaaggaggagagccgctcaggcgccaacaagtacctgtactttgtgtgcaacgagccgggcctgccatggacgcggctgccccacgtcactccagcccagatcgtgaacgcccgaaagatcaagaagttcttcacaggctacctggacacgccagtcgtcagctacccacccttcccgggcaacgaggccaactacctgcgggcccagatagcccgcatctcggccgccacgcaggtcagcccgctgggcttctaccagtttagtgaggaggagggcgacgaggaggaggaaggtggtgctgggcgcgactcctacgaggagaacccggacttcgagggcatccccgtgctggagctggtcgactccatggccaactgggtgcatcacacacagcacatcctgccgcagggccgctgcacttgggtgaaccctttgcagaagacagaggaggaggaggacctgggggaggaggaagagaaggcagatgaggggccagaggaggtggagcaggaggttggccccccactgctaacgccactttcagaagatgcagaaatcatgcacctggcaccctggaccacccgcctgtcctgcagcctctgcccgcagtactcagtggccgttgtgcgctccaacctctggcccggggcctatgcctatgccagtggcaatttgagaacatctacatcggctggggtcacaagtacagccccgagagcttcaacccggccctgccagcccccattcaacaagagtaccccagtggcccagagatcatggagatgagtgaccccacagtggaagaggagcaggctctgaaagcagcccaggaacaagccctgggagccacagaggaggaggaggagggcgaggaggaggaggagggcgaggagacagatgactgaggcccaccctctagccactttccccaagcaggtagatagcaaatttccccttagaggtagttagcatggattatattttcactatgtgcttcctgtccccagag

SEQ ID NO: 173698 - DNA, 2534 bp, Homo sapiens
  Payload ID: 14112
  Gene Symbol: RSPH9
  Gene Name: radial spoke head 9 homolog (Chlamydomonas)
  Uniprot ID: Q9H1X1
  ENST ID: ENST00000372163
  CDS Start-End: 54-884
ggaggcggcttctcctagcaactcgacgggcgttgagcggagccgctgacctgatggacgccgacagcctcctgctgtctctggagctggcgtccggcagtgggcagggcctcagcccggaccgtcgggcctcgctgctcacgtctcttatgctggttaagcgcgactaccgctatgatcgggttctcttctggggccgcatccttggcctcgtcgccgattactacatcgcgcagggcctgagtgaggaccagctcgcaccgcgcaagacgctctatagcctgaactgcacagagtggagcctcttgccccctgccacagaggagatggtggcgcagtcgtctgtggtgaagggccgcttcatgggggacccatcatacgaatatgaacacactgagctgcagaaggtgaatgaaggtgaaaaagtctttgaagaagaaatagtggtccagatcaaggaagagacccgcttggtgtctgtcattgaccagattgacaaggctgtggccatcatcccccgaggcgccctcttcaagaccccttttggacccacccatgtcaatcggacctttgaaggactgtccttgtctgaggccaagaagctcagctcctacttccatttcagggagcctgttgagctaaagaataagaccttgcttgagaaggctgacctggacccctccctggatttcatggactccttggagcatgacattcccaaagggtcctggagcatccagatggagaggggcaatgccctggtggtgctgcgcagcctgctctggccgggcctcaccttctaccatgctccccgcaccaagaactatggctacgtctacgtgggcactggcgagaagaacatggacttgcccttcatgctatagaatgggagccagcctggatgtttttaaacagagtctaaacatgattttcttaagcttcagtgaacttggcctgcctgttctgtcctatcttcttaactccacctccgtctggttccagattctgaaaggcccactgagccagggagctcatttctaaaccaagtggcagaggggttggaatgtgctaatgaaagagattctagacaacgatgggtggaaatggctgtgggagaaggtgacaaccagggcccctttgaggaacgcagtttcttggattcacacgagagcggcaagtgtgtcaggcagcccaccttggctccctgcagctctcccacagtaaggagctcacagctgtcatgaagaggatgggacctgtttggcccatgaattcaattgactcattggccccatcacaagagatcagtgactcaatgctcagcacccagctggcaatgtgcccaggaccccctgcacttcccaagcagtgagcgcacacccaatgggtaagcccatgaacccagtttatgacactgcgttgggcaaaactcctgtccccagcactgagcatggcctaagccccatagcagctggcaagggacccaactgccctgcctgcctctagctcccagcattgctactgtgcaggccaagggtactgaagttagtcccactgtcccctgtccatgcatgttggagggaccaggccatcgtggtggggtgggacaggagtatagttgtggccaagggcttgtgagtgggcctcctactccccagcacaggtgcaggaggaactctggaagcactgctctctgtcagtgatacagcttccaaggtgttcttgagtagcagacattgtccctcagaaggggtgaccccacgggcatgcgcaccctgttccagcgggggccttttttgtagatgggcttgacggagccaggagcccagcgcgtcaggtacctgtggagggagaacaaagaggtgcctgtgagggctgggggcccaagctggacgtgggagagtggagcactacctcctcaggccaggccacggttgggcaagcaaatcctttcaccagtttccctttcctgaagtgcagggattttcctgggagtaactgctgagcgtcctgtaaacagatgggctgggctcttgctgccgcaagcctgtgtggccaggttcaggcagcccagggccacaagctcccttgatctttgtaaatgtcaatgttggtgtgtgtttgctgaggaaaaggtggcgaagaggctgcctgaagagcagatcattcctctctggcctcagccatggggcgagaagagctgatgtaaggctctggaggaacccattgctcttccccatttggctcactcagctaccccaaccttcagggaactccccagggtactataactggtataagacccctgcccctcacccaacctgtgatgggaatcaaggggtaagggcccgtgggcgcagccctagcctaggaaggttcctgtaaataggaggggggtggggaaagatggctgccgcccatggacctttggcctcctttggggatggccagggccctgatagttcccagaaaagtggctcatgccggctaggattgggttttactctgtccagaataaaacttggatcctgtcc

SEQ ID NO: 173699 - DNA, 2586 bp, Homo sapiens
  Payload ID: 14112
  Gene Symbol: RSPH9
  Gene Name: radial spoke head 9 homolog (Chlamydomonas)
  Uniprot ID: Q9H1X1
  ENST ID: ENST00000372165
  CDS Start-End: 54-974
ggaggcggcttctcctagcaactcgacgggcgttgagcggagccgctgacctgatggacgccgacagcctcctgctgtctctggagctggcgtccggcagtgggcagggcctcagcccggaccgtcgggcctcgctgctcacgtctcttatgctggttaagcgcgactaccgctatgatcgggttctcttctggggccgcatccttggcctcgtcgccgattactacatcgcgcagggcctgagtgaggaccagctcgcaccgcgcaagacgctctatagcctgaactgcacagagtggagcctcttgccccctgccacagaggagatggtggcgcagtcgtctgtggtgaagggccgcttcatgggggacccatcatacgaatatgaacacactgagctgcagaaggtgaatgaaggtgaaaaagtctttgaagaagaaatagtgattgacaaggctgtggccatcatcccccgaggcgccctcttcaagaccccttttggacccacccatgtcaatcggacctttgaaggactgtccttgtctgaggccaagaagctcagctcctacttccatttcagggagcctgttgagctaaagaataagaccttgcttgagaaggctgacctggacccctccctggatttcatggactccttggagcatgacattcccaaagggtctgaggcagttgttcagggtgacttcacgtggcttctgagcaggtgtggttttggttggccctgttcctgggactcctgctctgtgtccatgagggtcctggagcatccagatggagaggggcaatgccctggtggtgctgcgcagcctgctctggccgggcctcaccttctaccatgctccccgcaccaagaactatggctacgtctacgtgggcactggcgagaagaacatggacttgcccttcatgctatagaatgggagccagcctggatgtttttaaacagagtctaaacatgattttcttaagcttcagtgaacttggcctgcctgttctgtcctatcttcttaactccacctccgtctggttccagattctgaaaggcccactgagccagggagctcatttctaaaccaagtggcagaggggttggaatgtgctaatgaaagagattctagacaacgatgggtggaaatggctgtgggagaaggtgacaaccagggcccctttgaggaacgcagtttcttggattcacacgagagcggcaagtgtgtcaggcagcccaccttggctccctgcagctctcccacagtaaggagctcacagctgtcatgaagaggatgggacctgtttggcccatgaattcaattgactcattggccccatcacaagagatcagtgactcaatgctcagcacccagctggcaatgtgcccaggaccccctgcacttcccaagcagtgagcgcacacccaatgggtaagcccatgaacccagtttatgacactgcgttgggcaaaactcctgtccccagcactgagcatggcctaagccccatagcagctggcaagggacccaactgccctgcctgcctctagctcccagcattgctactgtgcaggccaagggtactgaagttagtcccactgtcccctgtccatgcatgttggagggaccaggccatcgtggtggggtgggacaggagtatagttgtggccaagggcttgtgagtgggcctcctactccccagcacaggtgcaggaggaactctggaagcactgctctctgtcagtgatacagcttccaaggtgttcttgagtagcagacattgtccctcagaaggggtgaccccacgggcatgcgcaccctgttccagcgggggccttttttgtagatgggcttgacggagccaggagcccagcgcgtcaggtacctgtggagggagaacaaagaggtgcctgtgagggctgggggcccaagctggacgtgggagagtggagcactacctcctcaggccaggccacggttgggcaagcaaatcctttcaccagtttccctttcctgaagtgcagggattttcctgggagtaactgctgagcgtcctgtaaacagatgggctgggctcttgctgccgcaagcctgtgtggccaggttcaggcagcccagggccacaagctcccttgatctttgtaaatgtcaatgttggtgtgtgtttgctgaggaaaaggtggcgaagaggctgcctgaagagcagatcattcctctctggcctcagccatggggcgagaagagctgatgtaaggctctggaggaacccattgctcttccccatttggctcactcagctaccccaaccttcagggaactccccagggtactataactggtataagacccctgcccctcacccaacctgtgatgggaatcaaggggtaagggcccgtgggcgcagccctagcctaggaaggttcctgtaaataggaggggggtggggaaagatggctgccgcccatggacctttggcctcctttggggatggccagggccctgatagttcccagaaaagtggctcatgccggctaggattgggttttactctgtccagaataaaacttggatcctgtcc

SEQ ID NO: 173700 - DNA, 2528 bp, Homo sapiens
  Payload ID: 14113
  Gene Symbol: RSAD1
  Gene Name: radical S-adenosyl methionine domain containing 1
  Uniprot ID: Q9HA92
  ENST ID: ENST00000258955
  CDS Start-End: 86-1414
ctcttccttccgccggctgcgcactcacagtgatccctgcgcgcgtctcctgctcgggtcagtgcgccgcgctgcgctgggcgccatggcgctccccggagcccgggctcgcggctgggcggcagcagccagagcggcccagaggcgccgccgcgtggagaacgcaggagggtccccgagtcctgagcctgcgggccggcgcgcggcgctttacgtacactggccttactgcgagaagcgctgcagttactgcaacttcaacaagtacatccctcgccgcctggaggaggctgccatgcagaagtgtctggtgaccgaagctcagacgctgctgcggctcagcggggtgcaacgggtggagtctgtgttctttggtggggggacccccagtctagccagtccccacacggtggctgctgtcctggaggctgtggcacaggcagcccacctgcctgcagacttggaagtcacattggaggctaatcctacttcagctccgggctccagactggcagagttcggggcagcaggggttaacaggttgtctataggcctccagtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatggggcgctcagtacccacaattggacttactggcagtgtggtcagtaccttggcgttgggcctggggcccatggacgatttatgccccagggggctggaggccacacccgggaggctcggatccagacactggagcctgacaactggatgaaggaggtgatgctgtttggccatggcacccggaagcgtgtccccctgggcaggctggagctgctggaggaagttttggccctggggctacgcaccgatgtggggatcactcaccagcactggcagcagtttgagccccagctgaccctgtgggatgtgtttggagcgaacaaggaggtgcaggagctgctggagcggggcctactgcagctggatcacaggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccaggggaatggcagcagtgaggtagatgggaggacatttctggtcagggaactggcatcccattcagcatctcaggactcacaggccaacatgtgttccatggctgggaattgcctaccacccacatcagcttctgtttacctttttggcatcaaataatgaacagtgtttggaaatctttctacaggcaattacctccccaagagaagccttccttattttggagtaaggtcctaagatagctggatgaatcaggaaaaccatgtcccctctaggtattattaatataagcaggaagggatctactataggaatgaagtatttataaaccactgaaagggatagagaagtgaacattggagaaagccagtagcaactgtgagaaatcagcaacttgcaggaggcacagaaaactcctgctgatggtctcagcttccagcagcacaaaagcagatgatgtactggaaaatgctcagaagatgctacaaaacctcatgcctactgtctgccactgctggagaaggaatcatggtttctagaagtgcctctcattagtggactttaaagcaaatcctggctggcaggaaattctgaggaatatagctcttaggcttccagcctctaccatgcaggagagaacacagaaggactgatgtatgttggtggatccatgtatgtgtccagcacagcggcctgctggactctgagaactgggaaagatcagagcaagccttgcctcttatcttcgggaaaccagaatatgtttggggtggtaggagccacacagactcttctgagccccctcactcacttccttccccctgtgcctttcctttgagagtgaaggtgggtggagttgaccagagaaaggggagagaattcgggaaagacccaaagtgtttgtaattcttctttgtccttttacctacagaaatggtcacatggttctatttaaatagcctaataaacacatctggagcctgt

SEQ ID NO: 173701 - DNA, 930 bp, Homo sapiens
  Payload ID: 14113
  Gene Symbol: RSAD1
  Gene Name: radical S-adenosyl methionine domain containing 1
  ENST ID: ENST00000506211
  CDS Start-End: 1-588
gatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatggggcgctcagtacccacaattggacttactggcagtgtggtcagtaccttggcgttgggcctggggcccatggacgatttatgccccagggggctggaggccacacccgggaggctcggatccagacactggagcctgacaactggatgaaggaggctggaggaagttttggccctggggctacgcaccgatgtggggatcactcaccagcactggcagcagtttgagccccagctgaccctgtgggatgtgtttggagcgaacaaggaggtgcaggagctgctggagcggggcctactgcagctggatcacaggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtgggttttgagagctgggtcggtactgcagacatctcttctccgttgtcgggtgccgtctctgctccttgtggttattgctcagccctggcatccccagggga

SEQ ID NO: 173702 - DNA, 1029 bp, Homo sapiens
  Payload ID: 14113
  Gene Symbol: RSAD1
  Gene Name: radical S-adenosyl methionine domain containing 1
  Uniprot ID: Q9HA92
  ENST ID: ENST00000515221
  CDS Start-End: 26-613
agtgcgccgcgctgcgctgggcgccatggcgctccccggagcccgggctcgcggctgggcggcagcagccagagcggcccagaggcgccgccgcgtggagaacgcaggagggtccccgagtcctgagcctgcgggccggcgcgcggcgctttacgtacactccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatgggcccatggacgatttatgccccagggggctggaggccacacccgggaggctcggatccagacactggagcctgacaactggatgaaggaggtgatgctgtttggccatggcacccggaagcgtgtccccctgggcaggctggagctcactggcagcagtttgagccccagctgaccctgtgggatgtgtttggagcgaacaaggaggtgcaggagctgctggagcggggcctactgcagctggatcacaggtgtgttggggggtgccgggcagagggggctgaggcataccagggagccctgactacagctctccacagacccaggagaagtgagaaagactgactggggtcttcggtgttcctgggagggtctggctgtgctggactctctcttgctgaccctcctgcctcagctccaagaagcctggcagcagagaaccccctcccctgtgccaggaggatgacaaaaatgttcctgtgttccagggtaatgccaggtg

SEQ ID NO: 173703 - DNA, 1064 bp, Homo sapiens
  Payload ID: 14113
  Gene Symbol: RSAD1
  Gene Name: radical S-adenosyl methionine domain containing 1
  ENST ID: ENST00000504284
  CDS Start-End: 1-258
cgggctcgcggctgggcggcagcagccagagcggcccagaggcgccgccgcgtggagaacgcaggagggtccccgagtcctgagcctgcgggccggcgcgcggcgctttacgtacactggccttactgcgagaagcgctgcagttactgcaacttcaacaagtacatccctcgccgcctggaggaggctgccatgcagaagtgtctggtgaccgaagctcagacgctgctgcggctcagcggggtgcaacgtccctagatgacactgagctccggctgttgggacggacgcactcggcctgcgatgctctgcggacgctggcagaggcccggcgcctctttcccgggcgcgtgtctgtagacttgatgctggggctgccggcacagcaggtggggccgtggcttgggcagctgcaggaactgctgcaccactgtgatgaccacctctccctctaccagctgtccctggagcggggcaccgcactcttcgcccaggtgcagcggggtgcccttccagcccctgacccggagctcgcagctgagatgtaccagaggggccgggctgtccttcgggaggctggcttccaccagtatgaggtctccaactttgcccggaatggggcgctcagtacccacaattggacttactggcagtgtggtcagtaccttggcgttgggcctggggcccatggacgatttatgccccagggggctggaggccacacccgggaggctcggatccagacactggagcctgacaactggatgaaggaggtgatgctgtttggccatggcacccggaagcgtgtccccctgggcaggctggagctgctggaggaagttttggccctggggctacgcaccgatgtggggatcactcaccagcactggcagcagtttgagccccagctgaccctgtgggatgtgtttggagcgaacaaggaggtgcaggagctgctggagcggggcctactgcagctggatcacaggggtcttcggtgttcctgggagggtctggctgtgctggactctctcttgctgaccctcctgcctcagctccaagaa

SEQ ID NO: 173704 - DNA, 554 bp, Homo sapiens
  Payload ID: 14113
  Gene Symbol: RSAD1
  Gene Name: radical S-adenosyl methionine domain containing 1
  ENST ID: ENST00000510554
  CDS Start-End: 457-554
gtgtgtggccgcagccctggccgtgaccgtggccgtccaaaacccaggtggcggtttgtcactctatgaacccgcctgccgtgtttccgtgcccccgtacgaggtctgggatgggaccctgtgctttggcagggaaatgacttggtccagaaacctgaagtctctgctactcaccggctcggtgactctgaccaaatggttcaaatttcataacaattttcctcttagcaagacaaaattttcttaagagcagtgttctgactcggtagctgggaaaatggctcataggaaaattgtatgaaaattatatgatcccagaaagagcttgggttgaattccttcctgacgtctgctggttggaagaggcagcgtaacaaaggatggccttactgcgagaagcgctgcagttactgcaacttcaacaagtacatccctcgccgcctggaggaggctgccatgcagaagtgtctggtgaccgaagctcagacgctgctgcggctcagcggggtgcaacgggtggagtctgtgttctttggtggggggacccccagtct
